(12) United States Patent
Ledbetter et al.

(10) Patent No.: US 7,754,208 B2
(45) Date of Patent: Jul. 13, 2010

(54) BINDING DOMAIN-IMMUNOGLOBULIN FUSION PROTEINS

(75) Inventors: Jeffrey A Ledbetter, Shoreline, WA (US); Martha S Hayden-Ledbetter, Shoreline, WA (US)

(73) Assignee: Trubion Pharmaceuticals, Inc., Seattle, WA (US)

( * ) Notice: Subject to any disclaimer, the term of this patent is extended or adjusted under 35 U.S.C. 154(b) by 1120 days.

(21) Appl. No.: 10/207,655

(22) Filed: Jul. 25, 2002

(65) Prior Publication Data

US 2003/0118592 A1 Jun. 26, 2003

Related U.S. Application Data

(63) Continuation-in-part of application No. 10/053,530, filed on Jan. 17, 2002, now abandoned.

(60) Provisional application No. 60/367,358, filed on Jan. 17, 2001, provisional application No. 60/385,691, filed on Jun. 3, 2002.

(51) Int. Cl.
C07K 16/18 (2006.01)
C07K 16/28 (2006.01)
C07K 16/46 (2006.01)

(52) U.S. Cl. .................... 424/133.1; 530/391.1

(58) Field of Classification Search .............. 424/133.1; 530/391.1
See application file for complete search history.

(56) References Cited

U.S. PATENT DOCUMENTS

| | | |
|---|---|---|
| 5,098,833 A | 3/1992 | Lasky et al. |
| 5,260,203 A | 11/1993 | Ladner et al. |
| 5,434,131 A | 7/1995 | Linsley et al. |
| 5,455,030 A | 10/1995 | Ladner et al. |
| 5,521,288 A | 5/1996 | Linsley et al. |
| 5,530,101 A * | 6/1996 | Queen et al. ............. 530/387.3 |
| 5,580,756 A | 12/1996 | Linsley et al. |
| 5,605,690 A | 2/1997 | Jacobs et al. |
| 5,637,481 A | 6/1997 | Ledbetter et al. |
| 5,677,425 A | 10/1997 | Bodmer et al. |
| 5,709,859 A | 1/1998 | Aruffo et al. |
| 5,714,147 A | 2/1998 | Capon et al. |
| 5,736,137 A | 4/1998 | Rastetter et al. |
| 5,770,197 A | 6/1998 | Linsley et al. |
| 5,773,253 A | 6/1998 | Linsley et al. |
| 5,776,456 A | 7/1998 | Rastetter et al. |
| 5,844,093 A | 12/1998 | Kettleborough et al. |
| 5,844,095 A | 12/1998 | Linsley et al. |
| 5,869,049 A | 2/1999 | Noelle et al. |
| 5,876,718 A | 3/1999 | Noelle et al. |
| 5,916,560 A | 6/1999 | Larsen et al. |
| 6,074,644 A | 6/2000 | Pastan et al. |
| 6,087,329 A | 7/2000 | Armitage et al. |
| 6,090,914 A | 7/2000 | Linsley et al. |
| 6,147,203 A | 11/2000 | Pastan et al. |
| 6,150,584 A | 11/2000 | Kucherlapati et al. |
| 6,194,551 B1 | 2/2001 | Idusogie et al. |
| 6,264,951 B1 * | 7/2001 | Armitage et al. ......... 424/184.1 |
| 6,284,536 B1 | 9/2001 | Morrison et al. |
| 6,312,692 B1 | 11/2001 | Noelle et al. |
| 6,376,459 B1 | 4/2002 | Aruffo et al. |
| 6,384,198 B1 | 5/2002 | Diegel et al. |
| 6,403,769 B1 | 6/2002 | Larochelle et al. |
| 6,410,319 B1 | 6/2002 | Raubitschek et al. |
| 6,444,792 B1 | 9/2002 | Gray et al. |
| 6,472,510 B1 | 10/2002 | Aruffo et al. |
| 6,482,919 B2 | 11/2002 | Ledbetter et al. |
| 6,623,940 B1 | 9/2003 | Ledbetter et al. |
| 6,641,809 B1 | 11/2003 | Linsley et al. |
| 2001/0044135 A1 | 11/2001 | Stahi et al. |
| 2002/0004587 A1 * | 1/2002 | Miller et al. ............. 530/388.8 |
| 2002/0031510 A1 | 3/2002 | Larsen et al. |
| 2002/0039557 A1 | 4/2002 | White |
| 2002/0155604 A1 | 10/2002 | Ledbetter et al. |
| 2003/0044423 A1 * | 3/2003 | Gillies et al. ............. 424/192.1 |
| 2003/0133930 A1 | 7/2003 | Goldenberg et al. |

(Continued)

FOREIGN PATENT DOCUMENTS

EP 0274394 A2 7/1988

(Continued)

OTHER PUBLICATIONS

Shan et al. (J. Immunol. 162(11):6589-6595 (1999).*

(Continued)

*Primary Examiner*—Lynn Bristol
(74) *Attorney, Agent, or Firm*—Seed IP Law Group PLLC

(57) ABSTRACT

The invention relates to novel binding domain-immunoglobulin fusion proteins that feature a binding domain for a cognate structure such as an antigen, a counterreceptor or the like, a wild-type IgG1, IGA or IgE hinge region polypeptide or a mutant IgG1 hinge region polypeptide having either zero, one or two cysteine residues, and immunoglobulin CH2 and CH3 domains, and that are capable of ADCC and/or CDC while occurring predominantly as polypeptides that are compromised in their ability to form disulfide-linked multimers. The fusion proteins can be recombinantly produced at high expression levels. Also provided are related compositions and methods, including cell surface forms of the fusion proteins and immunotherapeutic applications of the fusion proteins and of polynucleotides encoding such fusion proteins.

8 Claims, 53 Drawing Sheets

U.S. PATENT DOCUMENTS

| | | | |
|---|---|---|---|
| 2003/0133939 A1* | 7/2003 | Ledbetter et al. | 424/178.1 |
| 2003/0219433 A1 | 11/2003 | Hansen | |
| 2003/0219436 A1 | 11/2003 | Ledbetter et al. | |
| 2003/0219446 A1 | 11/2003 | Linsley et al. | |
| 2003/0219876 A1 | 11/2003 | Ledbetter et al. | |
| 2004/0058445 A1 | 3/2004 | Ledbetter et al. | |

FOREIGN PATENT DOCUMENTS

| | | |
|---|---|---|
| EP | 0 555 880 A2 | 8/1993 |
| EP | 0586002 | 3/1994 |
| EP | 0 757 099 A2 | 7/1995 |
| EP | 0 682 039 A1 | 11/1995 |
| EP | 1 186 300 A1 | 3/2002 |
| WO | WO 88/04936 | 7/1988 |
| WO | WO 92/00092 | 1/1992 |
| WO | WO9221755 | 12/1992 |
| WO | WO 93/00431 | 1/1993 |
| WO | WO9405690 | 3/1994 |
| WO | WO9509917 | 4/1995 |
| WO | WO-98/02462 | 1/1998 |
| WO | WO 99/42077 | 8/1999 |
| WO | WO0044777 | 8/2000 |
| WO | WO-02/056910 | 7/2002 |
| WO | WO-02/072605 | 9/2002 |

OTHER PUBLICATIONS

Biocrawler.com/encyclopedia/glycosylation.*
Wu et al. (Protein Engineering 14(2):1025-1033 (2001).*
Yoshinaga et al. (Internat'l. Immunol. 12(10):1439-1447 (2000).*
Okazaki et al. (PNAS 98(24):13866-13871 (Nov. 20, 2001).*
Hayden et al. (Tissue Antigens 48(4 Pt 1):242-54 (1996).*
Tamura et al. (Blood 97(6):1809-1816 (Mar. 15, 2001).*
Dechant et al. Blood 100:4574-4580 (2002).*
Huls et al. Cancer Res. 59:5778-5784 (1999).*
MacCallum et al. (J. Mol. Biol. (1996) 262:732-745).*
Pascalis et al. The Journal of Immunology (2002) 169, 3076-3084.*
Casset et al. (2003) BBRC 307, 198-205.*
Vajdos et al. (2002) J. Mol. Biol. 320, 415-428.*
Holm et al (2007) Mol. Immunol. 44: 1075-1084.*
Chen et al. J. Mol. Bio. (1999) 293, 865-881.*
Wu et al. J. Mol. Biol. (1999) 294, 151-162.*
Smith-Gill et al. (J. Immunol. 139:4135-4144 (1987)).*
Kumar et al. (J. Biol. Chem. 275:35129-35136 (2000)).*
Song et al. (Biochem Biophys Res Comm 268:390-394 (2000)).*
Brummell et al. (Biochemistry 32:1180-1187 (1993)).*
Kobayashi et al. (Protein Engineering 12:879-844 (1999)).*
Burks et al. (PNAS 94:412-417 (1997)).*
Jang et al. (Molec. Immunol. 35:1207-1217 (1998)).*
Brorson et al. (J. Immunol. 163:6694-6701 (1999)).*
Coleman (Research in Immunol. 145:33-36 (1994)).*
Dufner (Trends Biotechnol. 24(11):523-29 (2006)).*
Aicher, et al., "Characterization of Human Inducible Costimulator Ligand Expression and Function", The Journal of Immunology, 2000, 164: 4689-4696.
Carter, "Improving the Efficacy of Antibody-Based Cancer", Nature, Nov. 2001, vol. 1, 118-129.
Clark et al., "Structure, Function, and Genetics of Human B Cell-Associated Surface Molecules", Advances in Cancer Research, vol. 52, 81-149.
Damle, et al., "Direct helper T cell-induced B cell differentiation involves interaction between T cell antigen CD28 and B cell activation antigen B7", Eur. J. Immunology 1991; 21; 1277-1282.
Davies, et al., "'Camelising' Human Antibody Fragments: NMR Studies on VH Domains," FEBS Letters 339 (1994) 285-290.
Desmyter et al., "Crystal structure of a camel single-domain $V_H$ antibody fragment in complex with lysozyme", Nature Structural Biology, vol. 3, No. 9, Sep. 1996, 803-811.
Dietsch et al., Coengagement of CD2 with LFA-1 or VLA-4 by bispecific ligand fusion proteins primes T cells to respond more effectively to T cell receptor-dependent signals, Journal of Leukocyte Biology, vol. 56, Oct. 1994, 444-452.
Dietsch et al., "Bispecific receptor globulins, novel tools for the study of cellular interactions", Journal of Immunological Methods, 162 (1993) 123-132.
Durie et al., "Prevention of Collagen-Induced Arthritis with an Antibody to gp39, the Ligand for CD40", Science, vol. 261, Sep. 3, 1993, 1328-1330.
Fell et al., "Genetic Construction and Characterization of a Fusion Protein Consisting of a Chimeric F (ab') with Specificity for Carcinomas and Human IL-2", The Journal of Immunology, vol. 146, 2446-2452, No. 7, Apr. 1, 1991.
Filpula et al., "Single-chain Fv designs for protein, cell and gene therapeutics" Exp. Opin. Ther. Patents (1999) 9 (3):231-245.
Gilliland et al., "Rapid and Reliable Cloning of antibody Variable Regions and Generation of Recombinant Single Chain Antibody Fragments", Tissue Antigens 1996: 47: 1-20 (Denmark0.
Hayden, et al., "Antibody Engineering," Curr. Opin. Immuno., 9:201-212 (1997).
Hayden, et al., "Single-chain Mono- and bispecific Antibody Derivatives With Novel Biological Properties and Antitumor Activity from a COS Cell Transient Expression System," Thera. Immuno., 1:3-15 (1994).
Hayden et al., "Costimulation by CD28 sFv expressed on the tumor cell surface or as a soluble bispecific molecule targeted to the L6 carcinoma antigen", Tissue Antigens 1996: 48; 242-254.
Hu, et al., "Minibody: A Novel Engineered Anti-Carcinoembryonic Antigen Antibody Fragment (Single-Chain Fv-CH3) Which Exhibits Rapid, High-Level Targeting of Xenografts," Cancer Res. 56(13):3055-3061 (1996).
Hudson, "Recombinant antibodies: a novel approach to cancer diagnosis and therapy", Exp. Opin. Invest. Drugs (2000) 9(6):1231-1242.
Hudson, "Recombinant antibody fragments", Current Opinion in Biotechnology, 1998, 9:395-402.
Kortt, et al., "Dimeric and Trimeric Antibodies: High Avidity scFvs for Cancer Targeting," Biomole. Eng., 18:95-108 (2001).
Lee et al., "Generation and characterization of a novel single-gene-encoded single-chain immunoglobulin molecule with antigen binding activity and effector functions", Molecular Immunology 36 (1999) 61-71.
Li, et al., "Single-chain antibodies against human insulin-like growth factor I receptor: expression, purification and effect on tumor growth", Cancer Immunol. Immunother (2000) 49:243-252.
Liu, et al., "Production of a Mouse-Human Chimeric Monoclonal Antibody to CD20 With Potent Fc-Dependent Biological Activity," J. Immunol. 139(10):3521-3526 (1987).
Multani et al., "Monoclonal Antibody-Based Therapeis for Hematologic Malignancies", Journal of Clinical Oncology, vol. 16, No. 11 (Nov. 1998): pp. 3691-3710.
Park et al., "Generation and Characterization of a Novel Tetravalent Bispecific antibody that binds to hepatitis B virus surface antigens", Molecular Immunology 37 (2000) 11-23-1130.
Segal et al., "Introduction: bispecific antibodies", Journal of Immunological Methods, 248 (2001) 1-6.
Shu et al., "Secretion of a single-gene-encoded immunoglobulin from myeloma cells", Proc. Natl. Acad. Sci. USA, vol. 90, 7995-7999, Sep. 1993.
Souriau et al., "Recombinant antibodies for cancer diagnosis and therapy", Expert Opin. Biol. Ther. (2003) 3(2):305-318.
Sporici et al., "ICOS Ligand Costimulation Is Required for T-Cell Encephalitogenicity", Clinical Immunology, vol. 100, No. 3, September, pp. 277-288,2001.
Wu, et al., "Multimerization of a Chimeric Anti-CD20 Single-chain Fv-Fc Fusion Protein is Mediated Through Variable Domain Exchange," Protein Eng., 14(12):1025-1033 (2001).
U.S. Appl. No. 09/590,284, filed Jun. 9, 2000, Goldenberg et al.
Munoz E. et The C(H)1 domain of IgG is not essential for C3 covalent binding: importance of the other constant domains as targets for C3. Int Immunol. Feb. 1998;10(2):97-106.
Martin S. et al., Efficient neutralization and disruption of rhinovirus by chimeric ICAM- 1/immunoglobulin molecules , J. Virol. 1993,67:3561-3568.

Stevenson G.T. et al., Mechanisms in removal of tumor by antibody. Cell Biophys. 1994;24-25:45-50.

Anderson et al., Targeted anti-cancer therapy using rituximab, a chimeric anti-CD-20 antibody (IDEC-c2B8) in the treatment of non-hodgkin's B-cell lymphoma; Biochemical Society Transactions Colcester, Essex, GB, p. 705-708; 1997.

Cruse et al., "Illustrated Dictionary of Immunology", CRC Press, 1995, p. 157.

Paul, "Fudamental Immunology", Raven Press, 1993, Chp. 8, p. 242.

Rudikoff et al., "Single amino acid substitution altering antigen-binding specificity", Proc Natl Acad Sci U S A, Mar. 1982, 79(6):1979-83.

Wang et al., "Human single-chain FV immunoconjugates targeted to a melanoma-associated chondroitin sulfate proteoglycan mediate specific lysis of human melanoma cells by natural killer cells and complement," *Proc. Natl. Acad. Sci. USA*, 96: 1627-1632 (1999).

Law et al., "Expression and characterization of recombinant soluble human CD3 molecules: presentation of antigenic epitopes defined on the native TCR-CD3 complex," International Immunology, 14:389-400 (2002).

Clark, Edward A., "Role of the Bp35 cell surface polypeptide in human B-cell activation," *Proc. Natl. Acad. Sci. USA* 82:1766-1770, Mar. 1985.

Welschof, Martin et al., "The Antigen Binding Domain of Non-idiotypic Human Anti-F(ab')$^2$ Autoantibodies: Study of their Interaction with IgG Hinge Region Epitopes," *Human Immunology* 60:282-290, 1999.

\* cited by examiner

Figure 1A

2H7scFv-Ig cDNA and predicted amino acid sequence:

```
      HindIII     NcoI        2H7 V_L Leader Peptide→
      ~~~~~~      ~~~~~~
                          M   D   F   Q   V   Q   I   F   S   F   L   L   I   S   A   S
  1   AAGCTTGCCG  CC   ATGGATTT TCAAGTGCAG ATTTTCAGCT TCCTGCTAAT CAGTGCTTCA 2H7 V_L →
       V   I   I   A   R   G   Q   I   V   L   S   Q   S   P   A   I   L   S   A   S
 61   GTCATAATTG CCAGAGGACA AATTGTTCTC TCCCAGTCTC CAGCAATCCT GTCTGCATCT P   G   E   K   V   T   M   T   C   R   A   S   S   S   V   S   Y   M   H   W
121   CCAGGGGAGA AGGTCACAAT GACTTGCAGG GCCAGCTCAA GTGTAAGTTA CATGCACTGG BamHI
                  ~~~~~~~
       Y   Q   Q   K   P   G   S   S   P   K   P   W   I   Y   A   P   S   N   L   A
181   TACCAGCAGA AGCCAGGATC CTCCCCCAAA CCCTGGATTT ATGCCCCATC CAACCTGGCT S   G   V   P   A   R   F   S   G   S   G   S   G   T   S   Y   S   L   T   I
241   TCTGGAGTCC CTGCTCGCTT CAGTGGCAGT GGGTCTGGGA CCTCTTACTC TCTCACAATC S   R   V   E   A   E   D   A   A   T   Y   Y   C   Q   Q   W   S   F   N   P
301   AGCAGAGTGG AGGCTGAAGA TGCTGCCACT TATTACTGCC AGCAGTGGAG TTTTAACCCA (Gly_4 Ser)_3 Linker
       P   T   F   G   A   G   T   K   L   E   L   K   G   G   G   S   G   G   G
361   CCCACGTTCG GTGCTGGGAC CAAGCTGGAG CTGAAAGGTG GCGGTGGCTC GGGCGGTGGT 2H7 V_H →
       G   S   G   G   G   G   S   S   Q   A   Y   L   Q   Q   S   G   A   E   L   V
421   GGATCTGGAG GAGGTGGGAG CTCTCAGGCT TATCTACAGC AGTCTGGGGC TGAGCTGGTG R   P   G   A   S   V   K   M   S   C   K   A   S   G   Y   T   F   T   S   Y
481   AGGCCTGGGG CCTCAGTGAA GATGTCCTGC AAGGCTTCTG GCTACACATT TACCAGTTAC N   M   H   W   V   K   Q   T   P   R   Q   G   L   E   W   I   G   A   I   Y
541   AATATGCACT GGGTAAAGCA GACACCTAGA CAGGGCCTGG AATGGATTGG AGCTATTTAT P   G   N   G   D   T   S   Y   N   Q   K   F   K   G   K   A   T   L   T   V
601   CCAGGAAATG GTGATACTTC CTACAATCAG AAGTTCAAGG GCAAGGCCAC ACTGACTGTA D   K   S   S   S   T   A   Y   M   Q   L   S   S   L   T   S   E   D   S   A
661   GACAAATCCT CCAGCACAGC CTACATGCAG CTCAGCAGCC TGACATCTGA AGACTCTGCG V   Y   F   C   A   R   V   V   Y   Y   S   N   S   Y   W   Y   F   D   V   W
721   GTCTATTTCT GTGCAAGAGT GGTGTACTAT AGTAACTCTT ACTGGTACTT CGATGTCTGG
```

Figure 1B

```
                                       BclI
                              ~~~~~~~human IgG1 Fc domain →
         G   T   G   T    T   V   T    V   S   D    Q   E   P    K   S   C   D    K   T   H
 781   GGCACAGGGA   CCACGGTCAC   CGTCTCTGAT   CAGGAGCCCA   AATCTTGTGA   CAAAACTCAC T   C   P   P   C   P   A    P   E   L    L   G   G   P    S   V   F    L   F   P
 841   ACATGCCCAC   CGTGCCCAGC   ACCTGAACTC   CTGGGGGGAC   CGTCAGTCTT   CCTCTTCCCC P   K   P   K   D   T   L    M   I   S    R   T   P   E    V   T   C    V   V   V
 901   CCAAAACCCA   AGGACACCCT   CATGATCTCC   CGGACCCCTG   AGGTCACATG   CGTGGTGGTG D   V   S   H    E   D   P    E   V   K    F   N   W   Y    V   D   G    V   E   V
 961   GACGTGAGCC   ACGAAGACCC   TGAGGTCAAG   TTCAACTGGT   ACGTGGACGG   CGTGGAGGTG H   N   A   K    T   K   P    R   E   E    Q   Y   N   S    T   Y   R    V   V   S
1021   CATAATGCCA   AGACAAAGCC   GCGGGAGGAG   CAGTACAACA   GCACGTACCG   TGTGGTCAGC V   L   T   V    L   H   Q    D   W   L    N   G   K   E    Y   K   C    K   V   S
1081   GTCCTCACCG   TCCTGCACCA   GGACTGGCTG   AATGGCAAGG   AGTACAAGTG   CAAGGTCTCC N   K   A   L    P   A   P    I   E   K    T   I   S   K    A   K   G    Q   P   R
1141   AACAAAGCCC   TCCCAGCCCC   CATCGAGAAA   ACAATCTCCA   AAGCCAAAGG   GCAGCCCCGA E   P   Q   V    Y   T   L    P   P   S    R   D   E   L    T   K   N    Q   V   S
1201   GAACCACAGG   TGTACACCCT   GCCCCCATCC   CGGGATGAGC   TGACCAAGAA   CCAGGTCAGC L   T   C   L    V   K   G    F   Y   P    S   D   I   A    V   E   W    E   S   N
1261   CTGACCTGCC   TGGTCAAAGG   CTTCTATCCC   AGCGACATCG   CCGTGGAGTG   GGAGAGCAAT G   Q   P   E    N   N   Y    K   T   T    P   P   V   L    D   S   D    G   S   F
1321   GGGCAGCCGG   AGAACAACTA   CAAGACCACG   CCTCCCGTGC   TGGACTCCGA   CGGCTCCTTC F   L   Y   S    K   L   T    V   D   K    S   R   W   Q    Q   G   N    V   F   S
1381   TTCCTCTACA   GCAAGCTCAC   CGTGGACAAG   AGCAGGTGGC   AGCAGGGGAA   CGTCTTCTCA C   S   V   M    H   E   A    L   H   N    H   Y   T    Q   K   S   L    S   L   S
1441   TGCTCCGTGA   TGCATGAGGC   TCTGCACAAC   CACTACACGC   AGAAGAGCCT   CTCCCTGTCT XbaI
                     ~~~~~
         P   G   K   *   S   R
1501   CCGGGTAAAT   GATCTAGA
```

2H7scFvIg Standard Curve

| Clone | LFE @ 1:50 | Estimated Concentration (μg/ml) |
|---|---|---|
| D2 | 26.1 | 56 |
| IIIC6 | 25.7 | 55 |
| IVA3 | 28.6 | 61 |
| Spent bulk | 29.6 | 64 |

Figure 4A

Complement Mediated B Cell Killing After Binding of CD20-targeted 2H7 Derivatives:

| 2H7scFv-Ig Concentration | RAMOS | BJAB |
|---|---|---|
| 20 μg/ml + complement | 0.16 | 0.07 |
| 5 μg/ml + complement | 0.2 | N.D. |
| 1.25 μg/ml + complement | 0.32 | 0.1 |
| Complement alone | 0.98 | 0.94 |

*Viability was determined by trypan blue exclusion and is tabulated as the fraction of viable cells out of the total number of cells counted.

**N.D. (not determined).

Figure 4B

Antibody-dependent cellular cytotoxicity (ADCC) mediated by 2H7scFv-Ig:

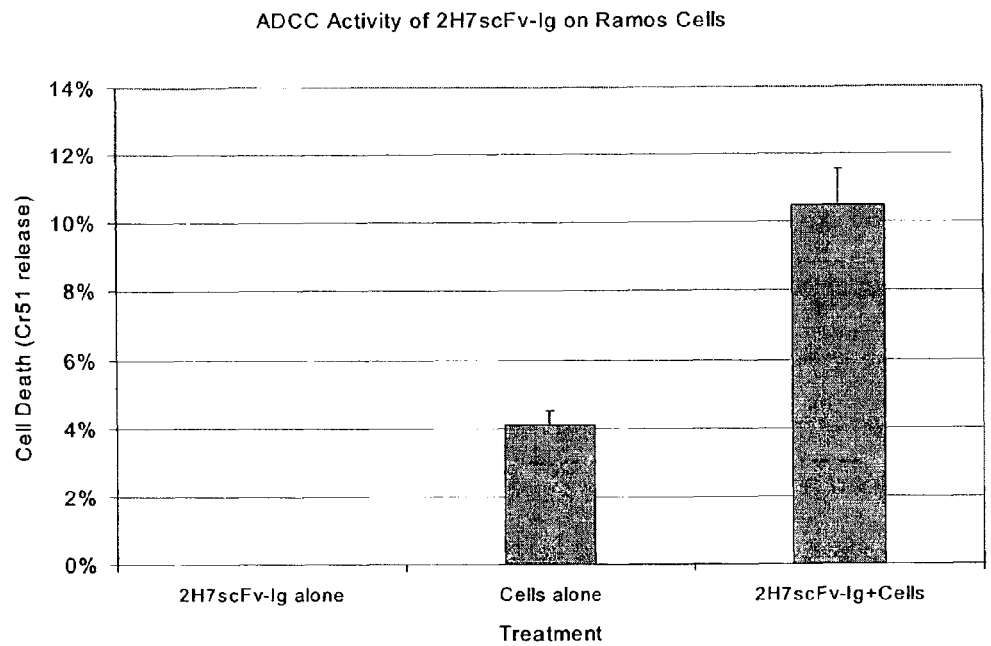

Figure 7A

2H7-CD154 L2 cDNA and predicted amino acid sequence:

```
       HindIII      NcoI    2H7 V_L Leader Peptide →
       ~~~~~~       ~~~~~~
                            M   D   F   Q   V   Q   I   F   S   F   L   L   I   S   A   S
  1    AAGCTTGCCG CC    ATGGATTT TCAAGTGCAG ATTTTCAGCT TCCTGCTAAT CAGTGCTTCA 2H7 V_L →
       V   I   I   A   R   G   Q   I   V   L   S   Q   S   P   A   I   L   S   A   S
 61    GTCATAATTG CCAGAGGACA AATTGTTCTC TCCCAGTCTC CAGCAATCCT GTCTGCATCT P   G   E   K   V   T   M   T   C   R   A   S   S   S   V   S   Y   M   H   W
121    CCAGGGGAGA AGGTCACAAT GACTTGCAGG GCCAGCTCAA GTGTAAGTTA CATGCACTGG BamHI
                  ~~~~~~~
       Y   Q   Q   K   P   G   S   S   P   K   P   W   I   Y   A   P   S   N   L   A
181    TACCAGCAGA AGCCAGGATC CTCCCCCAAA CCCTGGATTT ATGCCCCATC CAACCTGGCT S   G   V   P   A   R   F   S   G   S   G   S   G   T   S   Y   S   L   T   I
241    TCTGGAGTCC CTGCTCGCTT CAGTGGCAGT GGGTCTGGGA CCTCTTACTC TCTCACAATC S   R   V   E   A   E   D   A   A   T   Y   Y   C   Q   Q   W   S   F   N   P
301    AGCAGAGTGG AGGCTGAAGA TGCTGCCACT TATTACTGCC AGCAGTGGAG TTTTAACCCA (Gly_4Ser)_3 Linker →
       P   T   F   G   A   G   T   K   L   E   L   K   G   G   G   S   G   G   G
361    CCCACGTTCG GTGCTGGGAC CAAGCTGGAG CTGAAAGGTG GCGGTGGCTC GGGCGGTGGT 2H7 V_H →
       G   S   G   G   G   S   S   Q   A   Y   L   Q   Q   S   G   A   E   L   V
421    GGATCTGGAG GAGGTGGGAG CTCTCAGGCT TATCTACAGC AGTCTGGGGC TGAGCTGGTG R   P   G   A   S   V   K   M   S   C   K   A   S   G   Y   T   F   T   S   Y
481    AGGCCTGGGG CCTCAGTGAA GATGTCCTGC AAGGCTTCTG GCTACACATT TACCAGTTAC N   M   H   W   V   K   Q   T   P   R   Q   G   L   E   W   I   G   A   I   Y
541    AATATGCACT GGGTAAAGCA GACACCTAGA CAGGGCCTGG AATGGATTGG AGCTATTTAT P   G   N   G   D   T   S   Y   N   Q   K   F   K   G   K   A   T   L   T   V
601    CCAGGAAATG GTGATACTTC CTACAATCAG AAGTTCAAGG GCAAGGCCAC ACTGACTGTA D   K   S   S   S   T   A   Y   M   Q   L   S   S   L   T   S   E   D   S   A
661    GACAAATCCT CCAGCACAGC CTACATGCAG CTCAGCAGCC TGACATCTGA AGACTCTGCG V   Y   F   C   A   R   V   V   Y   Y   S   N   S   Y   W   Y   F   D   V   W
721    GTCTATTTCT GTGCAAGAGT GGTGTACTAT AGTAACTCTT ACTGGTACTT CGATGTCTGG
```

Figure 7B human CD154/amino acid 48→

```
                            Bcl/Bam hybrid site
       G   T   G   T     T   V   T     V   S   D     P   R   R   L     D   K   I     E   D   E
781    GGCACAGGGA    CCACGGTCAC    CGTCTCTGAT    CCAAGAAGGT    TGGACAAGAT    AGAAGATGAA R   N   L   H     E   D   F     V   F   M     K   T   I   Q     R   C   N     T   G   E
841    AGGAATCTTC    ATGAAGATTT    TGTATTCATG    AAAACGATAC    AGAGATGCAA    CACAGGAGAA R   S   L   S     L   L   N     C   E   E     I   K   S   Q     F   E   G     F   V   K
901    AGATCCTTAT    CCTTACTGAA    CTGTGAGGAG    ATTAAAAGCC    AGTTTGAAGG    CTTTGTGAAG BclI
       D   I   M   L     N   K   E     E   T   K     K   E   N   S     F   E   M     Q   K   G
961    GATATAATGT    TAAACAAAGA    GGAGACGAAG    AAAGAAAACA    GCTTTGAAAT    GCAAAAAGGT BclI
       ~~~~~
       D   Q   N   P     Q   I   A     A   H   V     I   S   E   A     S   S   K     T   T   S
1021   GATCAGAATC    CTCAAATTGC    GGCACATGTC    ATAAGTGAGG    CCAGCAGTAA    AACAACATCT V   L   Q   W     A   E   K     G   Y   Y     T   M   S   N     N   L   V     T   L   E
1081   GTGTTACAGT    GGGCTGAAAA    AGGATACTAC    ACCATGAGCA    ACAACTTGGT    AACCCTGGAA N   G   K   Q     L   T   V     K   R   Q     G   L   Y   Y     I   Y   A     Q   V   T
1141   AATGGGAAAC    AGCTGACCGT    TAAAAGACAA    GGACTCTATT    ATATCTATGC    CCAAGTCACC HindIII
                         ~~~~~~~
       F   C   S   N     R   E   A     S   S   Q     A   P   F   I     A   S   L     C   L   K
1201   TTCTGTTCCA    ATCGGGAAGC    TTCGAGTCAA    GCTCCATTTA    TAGCCAGCCT    CTGCCTAAAG S   P   G   R     F   E   R     I   L   L     R   A   A   N     T   H   S     S   A   K
1261   TCCCCCGGTA    GATTCGAGAG    AATCTTACTC    AGAGCTGCAA    ATACCCACAG    TTCCGCCAAA P   C   G   Q     Q   S   I     H   L   G     G   V   F   E     L   Q   P     G   A   S
1321   CCTTGCGGGC    AACAATCCAT    TCACTTGGGA    GGAGTATTTG    AATTGCAACC    AGGTGCTTCG NcoI
                                                              ~~~~~~~
       V   F   V   N     V   T   D     P   S   Q     V   S   H   G     T   G   F     T   S   F
1381   GTGTTTGTCA    ATGTGACTGA    TCCAAGCCAA    GTGAGCCATG    GCACTGGCTT    CACGTCCTTT XhoI          XbaI
                         ~~~~~~        ~~~~
       G   L   L   K     L   E   *     *   S   R
1441   GGCTTACTCA    AACTCGAGTG    ATAATCTAGA
```

Figure 7C

2H7scFv-CD154 S4 cDNA and predicted amino acid sequence:

```
     HindIII       NcoI
     ~~~~~~        ~~~~~~2H7 V_L Leader Peptide→
                         M   D   F   Q   V   Q   I   F   S   F   L   L   I   S   A   S
  1  AAGCTTGCCG CC  ATGGATTT TCAAGTGCAG ATTTTCAGCT TCCTGCTAAT CAGTGCTTCA 2H7 V_L →
         V   I   I   A   R   G   Q   I   V   L   S   Q   S   P   A   I   L   S   A   S
 61      GTCATAATTG CCAGAGGACA AATTGTTCTC TCCCAGTCTC CAGCAATCCT GTCTGCATCT P   G   E   K   V   T   M   T   C   R   A   S   S   S   V   S   Y   M   H   W
121      CCAGGGAGA AGGTCACAAT GACTTGCAGG GCCAGCTCAA GTGTAAGTTA CATGCACTGG BamHI
                         ~~~~~~~
         Y   Q   Q   K   P   G   S   S   P   K   P   W   I   Y   A   P   S   N   L   A
181      TACCAGCAGA AGCCAGGATC CTCCCCCAAA CCCTGGATTT ATGCCCCATC CAACCTGGCT S   G   V   P   A   R   F   S   G   S   G   S   G   T   S   Y   S   L   T   I
241      TCTGGAGTCC CTGCTCGCTT CAGTGGCAGT GGGTCTGGGA CCTCTTACTC TCTCACAATC S   R   V   E   A   E   D   A   A   T   Y   Y   C   Q   Q   W   S   F   N   P
301      AGCAGAGTGG AGGCTGAAGA TGCTGCCACT TATTACTGCC AGCAGTGGAG TTTTAACCCA (Gly_4Ser)_3 Linker →
         P   T   F   G   A   G   T   K   L   E   L   K   G   G   G   S   G   G   G
361      CCCACGTTCG GTGCTGGGAC CAAGCTGGAG CTGAAAGGTG GCGGTGGCTC GGGCGGTGGT 2H7 V_H →
         G   S   G   G   G   G   S   S   Q   A   Y   L   Q   Q   S   G   A   E   L   V
421      GGATCTGGAG GAGGTGGGAG CTCTCAGGCT TATCTACAGC AGTCTGGGGC TGAGCTGGTG R   P   G   A   S   V   K   M   S   C   K   A   S   G   Y   T   F   T   S   Y
481      AGGCCTGGGG CCTCAGTGAA GATGTCCTGC AAGGCTTCTG GCTACACATT TACCAGTTAC N   M   H   W   V   K   Q   T   P   R   Q   G   L   E   W   I   G   A   I   Y
541      AATATGCACT GGGTAAAGCA GACACCTAGA CAGGGCCTGG AATGGATTGG AGCTATTTAT P   G   N   G   D   T   S   Y   N   Q   K   F   K   G   K   A   T   L   T   V
601      CCAGGAAATG GTGATACTTC CTACAATCAG AAGTTCAAGG GCAAGGCCAC ACTGACTGTA D   K   S   S   S   T   A   Y   M   Q   L   S   S   L   T   S   E   D   S   A
661      GACAAATCCT CCAGCACAGC CTACATGCAG CTCAGCAGCC TGACATCTGA AGACTCTGCG V   Y   F   C   A   R   V   V   Y   Y   S   N   S   Y   W   Y   F   D   V   W
721      GTCTATTTCT GTGCAAGAGT GGTGTACTAT AGTAACTCTT ACTGGTACTT CGATGTCTGG
```

Figure 7D human CD154/amino acid 108 →

```
                       Bcl/Bam hybrid site                       BclI
         G  T  G  T     T  V  T     V  S  D     P  E  N  S     F  E  M     Q  K  G
 781     GGCACAGGGA    CCACGGTCAC   CGTCTCTGAT   CCAGAAAACA    GCTTTGAAAT  GCAAAAAGGT BclI
         ~~~~~
         D  Q  N  P     Q  I  A     A  H  V     I  S  E  A     S  S  K     T  T  S
 841     GATCAGAATC    CTCAAATTGC   GGCACATGTC   ATAAGTGAGG    CCAGCAGTAA  AACAACATCT V  L  Q        W  A  E  K     G  Y  Y     T  M  S  N     N  L  V     T  L  E
 901     GTGTTACAGT    GGGCTGAAAA   AGGATACTAC   ACCATGAGCA    ACAACTTGGT  AACCCTGGAA N  G  K  Q     L  T  V     K  R  Q     G  L  Y  Y     I  Y  A     Q  V  T
 961     AATGGGAAAC    AGCTGACCGT   TAAAAGACAA   GGACTCTATT    ATATCTATGC  CCAAGTCACC HindIII
                                    ~~~~~~~~
         F  C  S        N  R  E  A     S  S  Q     A  P  F  I     A  S  L     C  L  K
1021     TTCTGTTCCA    ATCGGGAAGC   TTCGAGTCAA   GCTCCATTTA    TAGCCAGCCT  CTGCCTAAAG S  P  G        R  F  E  R     I  L  L     R  A  A  N     T  H  S     S  A  K
1081     TCCCCCGGTA    GATTCGAGAG   AATCTTACTC   AGAGCTGCAA    ATACCCACAG  TTCCGCCAAA P  C  G        Q  Q  S  I     H  L  G     V  F  E  L     Q  P     G  A  S
1141     CCTTGCGGGC    AACAATCCAT   TCACTTGGGA   GGAGTATTTG    AATTGCAACC  AGGTGCTTCG NcoI
                                                              ~~~~~~~
         V  F  V        N  V  T  D     P  S  Q     V  S  H  G     T  G  F     T  S  F
1201     GTGTTTGTCA    ATGTGACTGA   TCCAAGCCAA   GTGAGCCATG    GCACTGGCTT  CACGTCCTTT XhoI         XbaI
                       ~~~~~~       ~~~~
         G  L  L        K  L  E    *    *  S  R
1261     GGCTTACTCA    AACTCGACTG   ATAATCTAGA
```

......control supernatant   ___2H7scFv-CD154 supernatant

Figure 11
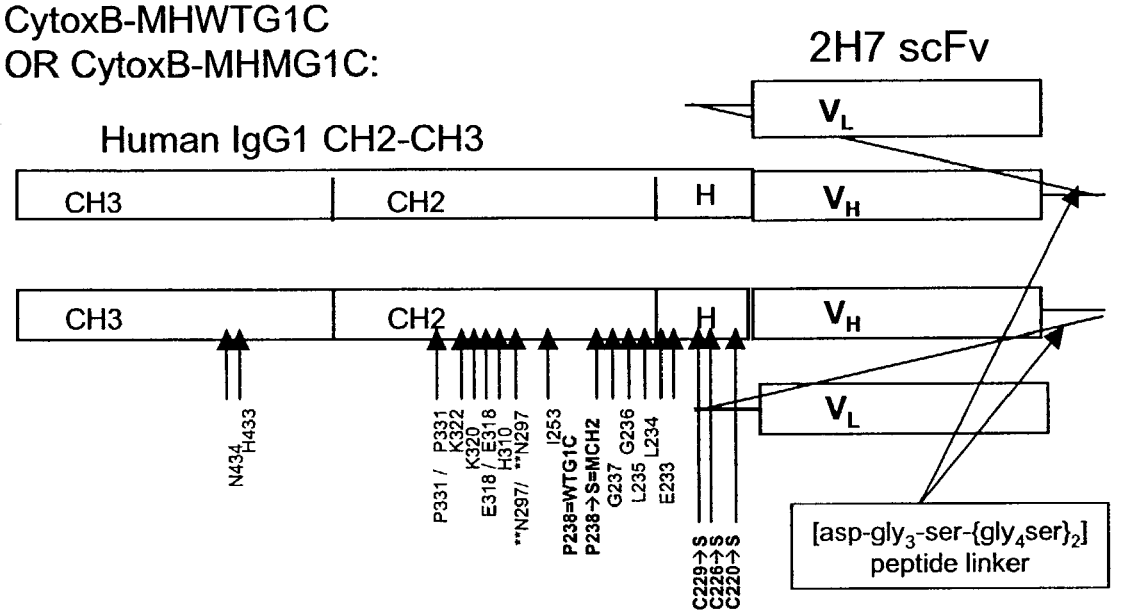
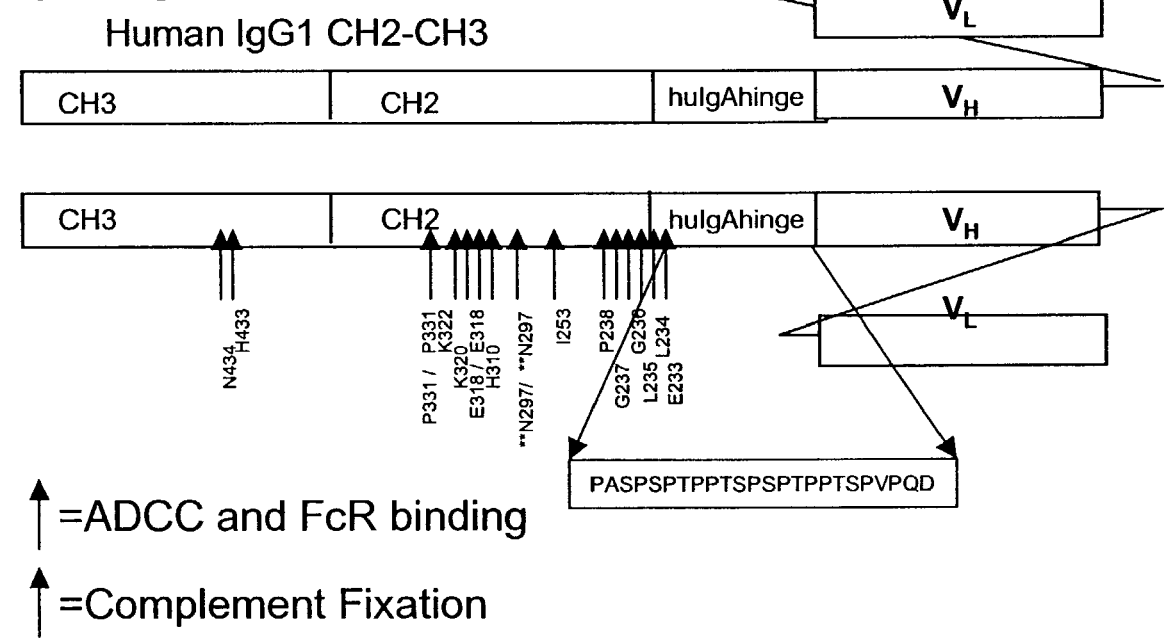
↑ =ADCC and FcR binding
↑ =Complement Fixation Standard Curve of HD37 scFvIg Derivative
Binding to B Cells

| Clone/Isolate | Mean LFE at 1:100 | Estimated Concentration |
|---|---|---|
| Bulk IgAHWTG1C | 11.2 | > 60 ug/ml |
| 1B2 | 10.4 | >50 ug/ml |
| 6C5 | 10.5 | >50 ug/ml |
| 4B1 | 8.6 | >40 ug/ml |
| | | |
| Bulk MHWTG1C | 10.9 | > 50 ug/ml |
| 2G8 | 10.6 | > 50 ug/ml |
| 3F3 | 8.3 | >40 ug/ml |
| 3D9 | 11.1 | > 60 ug/ml |

L6 scFvIg Standard Curves

| Construct | Mean LFE 1:20 | Estimated Concentration |
|---|---|---|
| L6IgAHWTG1C unamplified CHO sup | 51.1 | 6.25 ug/ml |
| L6IgGMHWTG1C unamplified CHO sup | 23.0 | 3.2 ug/ml |

Figure 19
A. 2H7 (anti-CD20) scFv Derivatives
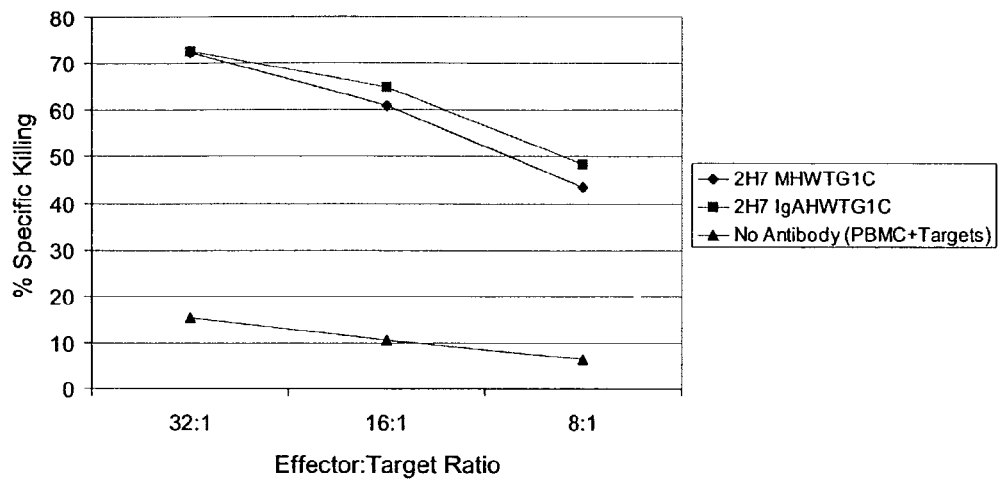
B. G28-1 (anti-CD37) scFv Derivatives
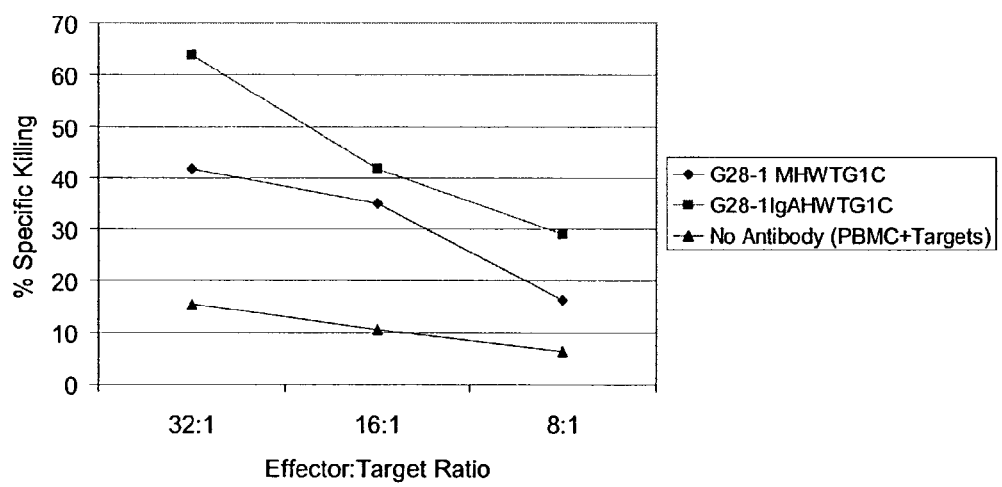
C. HD37 (anti-CD19) scFv Derivatives
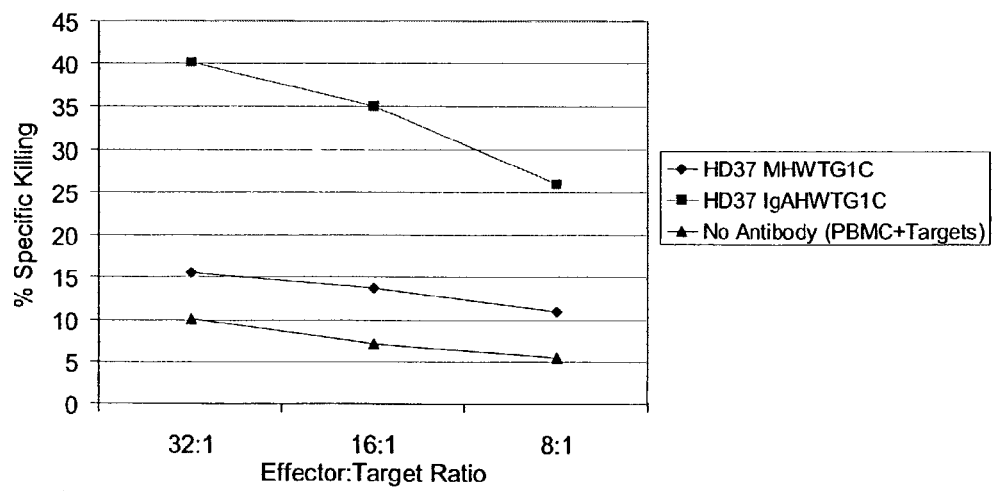

Figure 23

```
                Hinge                                CH2
Human IgG1: DQEPKSCDKT--------HTCPPC PAPELLGGPSVFLFPPKPKDTLMISRTPEVTCVVVDVSHEDPEVKFNWYVDG
Llama IgG2: DQEPKTPKPQPQPQPNPTTESKCPKC PAPELLGGPSVFIFPPKPKDVLSISGRPEVTCVVVDVGQEDPEVSFNWYIDG
Llama IgG1: --EPHGG--------------CTCPQC PAPELPGGPSVFVFPPKPKPKDVLSISGRPEVTCVVVDVGKEDPEVNFNWYIDG
Llama IgG3: --AHHSEDPT-----------SKCPKC PGPELLGGPTVFIFPPKAKDVLSITRKPEVTCLWWTWVKKTLRSSSSWSVDD CH3
VEVHNAKTKPREEQYNSTYRVVSVLTVLHQDWLNGKEYKCKVSNKALPAPIEKTISKAKGQPREPQVYTLPPSRDELTKNQVSLT
TAEVRANTRPKEEQFNSTYRVVSVLPIQHQDWLTGKEFKCKVNNKALPAPIEKTISKAKGQTREPQVYTLAPHREELAKDTVSVT
VEVRTANTKPKEEQFNSTYRVVSVLPIQHQDWLTGKEFKCKVNNKALPAPIERTISKAKGQTREPQVYTLAPHREELAKDTVSVT
TEVHTAETKPKEEQFNSTYRVVSVLPIQHQDWLTGKEFKCKVNNKALPAPIERTISKAKGQTREPQVYTLAPHREELAKDTVSVT CLVKGFYPSDIAVEWESNGQPEN---NYKTTPPVLDSDGSFFLYSKLTVDKSRWQQGNVFSCSVMHEALHNHYTQKSLSLSPGK
CLVKGFYPPDINVEWQRNGQPESXGTYATTPPQLDNDGTYFLXSKXSVGKNTWQQGETFTCVVMHEALHNHYTQKSITQSSGK
CLVKGFYPADINVEWQRNGQPESEGTYANTPPQLDNDGTYFLYSRLSVGKNTWQRGETLTGVVMHEALHNHYTQKSITQSSGK
CLVKGFFPADINVEWQRNGQPESEGTYANTPPQLDNDGTYFLYSKLSVGKNTWQQGEVFTCVVMHEALHNHSTQKSITQSSGK
```

Figure 31

| Name Identifier | Hinge Sequence | CH2 Sequence | CH3 Sequence | SEQ ID NO: |
|---|---|---|---|---|
| IgG WTH (CCC) WTCH2CH3 | IgG WT Hinge (CCC) | Wild Type CH2 | Wild Type CH3 | |
| IgG MTH (SSS) WTCH2CH3 | IgG1 Mutant Hinge (SSS) | Wild type CH2 (IgG1) | Wild type CH3 (IgG1) | |
| VH SER 11 IgG MTH (SSS) WTCH2CH3 | IgG1 Mutant Hinge (SSS) | Wild type CH2 (IgG1) | Wild type CH3 (IgG1) | |
| IgG (SSC) WTCH2CH3 | IgG1 Mutant Hinge (SSC) | Wild type CH2 (IgG1) | Wild type CH3 (IgG1) | |
| IgG (SCS) WTCH2CH3 | IgG1 Mutant Hinge (SCS) | Wild type CH2 (IgG1) | Wild type CH3 (IgG1) | |
| IgG (CSS) WTCH2CH3 | IgG1 Mutant Hinge (CSS) | Wild type CH2 (IgG1) | Wild type CH3 (IgG1) | |
| IgG MTH (SSS) MTCH2WTCH3 | IgG1 Mutant Hinge (SSS) | Mutant CH2 (IgG1) Pro → Ser 238 | Wild type CH3 (IgG1) | |
| IgAH IgGWTCH2CH3 | IgA Hinge | Wild type IgG1 CH2 | Wild type IgG1 CH3 | |
| IgAH IgACH2CH3 | IgA Hinge | Wild type CH2 (IgA) | Wild type CH3 (IgA) | |
| IgAH IgA-T4 | IgA Hinge | Wild type CH2 (IgA) | Truncated CH3 (IgA) (deletion of 4 amino acids at carboxy terminus) | |

A

B

BINDING DOMAIN-IMMUNOGLOBULIN FUSION PROTEINS

CROSS REFERENCE TO RELATED APPLICATIONS

This application is a Continuation-in-Part of U.S. Ser. No. 10/053,530, filed Jan. 17, 2002 (now abandoned), which is incorporated herein by reference in its entirety and which claims the benefit of priority of U.S. Provisional Application No. 60/367,358 (formerly U.S. Ser. No. 09/765,208, filed Jan. 17, 2001), also incorporated herein by reference in its entirety and for which a Petition to Convert a Non-Provisional Application to a Provisional Application was filed on Jan. 16, 2002, and granted on Jun. 6, 2002. This application also claims the benefit of priority of U.S. Provisional Application No. 60/385,691 filed on Jun. 3, 2002, and entitled "Recombinant Signaling Receptors for Tumor Gene Therapy", which is also incorporated herein by reference in its entirety.

The sequence listing associated with this application is submitted in text format in lieu of a paper copy. The name of the text file containing the Sequence Listing is 910180_401C1_SEQUENCE LISTING.txt. The text file is 1.39 MB, and was created on Aug. 18, 2009, and is being submitted electronically via EFS-Web. The contents of the text file are incorporated herein by reference in its entirety.

BACKGROUND OF THE INVENTION

The present invention relates generally to immunologically active, recombinant binding proteins, and in particular, to molecularly engineered binding domain-immunoglobulin fusion proteins, including single chain Fv-immunoglobulin fusion proteins. The present invention also relates to compositions and methods for treating malignant conditions and B-cell disorders, including diseases characterized by autoantibody production.

An immunoglobulin molecule is a multimeric protein composed of two identical light chain polypeptides and two identical heavy chain polypeptides ($H_2L_2$) that are joined into a macromolecular complex by interchain disulfide bonds. Intrachain disulfide bonds join different areas of the same polypeptide chain, which results in the formation of loops that, along with adjacent amino acids, constitute the immunoglobulin domains. At the amino-terminal portion, each light chain and each heavy chain has a single variable region that shows considerable variation in amino acid composition from one antibody to another. The light chain variable region, $V_L$, associates with the variable region of a heavy chain, $V_H$, to form the antigen binding site of the immunoglobulin, Fv. Light chains have a single constant region domain and heavy chains have several constant region domains. Classes IgG, IgA, and IgD have three constant region domains, which are designated CH1, CH2, and CH3, and the IgM and IgE classes have four constant region domains, CH1, CH2, CH3 and CH4. Immunoglobulin structure and function are reviewed, for example, in Harlow et al., Eds., *Antibodies: A Laboratory Manual*, Chapter 14, Cold Spring Harbor Laboratory, Cold Spring Harbor (1988).

The heavy chains of immunoglobulins can be divided into three functional regions: Fd (fragment comprising VH and CH1), hinge, and Fc (fragment crystallizable, derived from constant regions). The Fd region comprises the $V_H$ and CH1 domains and in combination with the light chain forms Fab, the antigen-binding fragment. The Fc fragment is generally considered responsible for the effector functions of an immunoglobulin, such as complement fixation and binding to Fc receptors. The hinge region, found in IgG, IgA, and IgD classes, acts as a flexible spacer, allowing the Fab portion to move freely in space. In contrast to the constant regions, the hinge domains are structurally diverse, varying in both sequence and length among immunoglobulin classes and subclasses. For example, three human IgG subclasses, IgG1, IgG2, and IgG4, have hinge regions of 12-15 amino acids, while IgG3-derived hinge regions can comprise approximately 62 amino acids, including around 21 proline residues and around 11 cysteine residues.

According to crystallographic studies, the immunoglobulin hinge region can be further subdivided functionally into three regions: the upper hinge, the core, and the lower hinge (Shin et al., *Immunological Reviews* 130:87 (1992)). The upper hinge includes amino acids from the carboxyl end of CH1 to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the CH2 domain and includes residues in CH2. (Id.) The core hinge region of human IgG1 contains the sequence Cys-Pro-Pro-Cys (SEQ ID NO: 40) which, when dimerized by disulfide bond formation, results in a cyclic octapeptide believed to act as a pivot, thus conferring flexibility. The hinge region may also contain one or more glycosylation sites, which include a number of structurally distinct types of sites for carbohydrate attachment. For example, IgA1 contains five glycosylation sites within a 17 amino acid segment of the hinge region, conferring exceptional resistance of the hinge region polypeptide to intestinal proteases, considered an advantageous property for a secretory immunoglobulin.

Conformational changes permitted by the structure and flexibility of the immunoglobulin hinge region polypeptide sequence may affect the effector functions of the Fc portion of the antibody. Three general categories of effector functions associated with the Fc region include (1) activation of the classical complement cascade, (2) interaction with effector cells, and (3) compartmentalization of immunoglobulins. The different human IgG subclasses vary in the relative efficacies with which they fix complement, or activate and amplify the steps of the complement cascade (e.g., Kirschfink, 2001 *Immunol. Rev.* 180:177; Chakraborti et al., 2000 *Cell Signal* 12:607; Kohl et al., 1999 *Mol. Immunol.* 36:893; Marsh et al., 1999 *Curr. Opin. Nephrol. Hypertens.* 8:557; Speth et al., 1999 *Wien Klin. Wochenschr.* 111:378). Complement-dependent cytotoxicity (CDC) is believed to be a significant mechanism for clearance of specific target cells such as tumor cells. In general, IgG1 and IgG3 most effectively fix complement, IgG2 is less effective, and IgG4 does not activate complement. Complement activation is initiated by binding of C1q, a subunit of the first component C1 in the cascade, to an antigen-antibody complex. Even though the binding site for C1q is located in the CH2 domain of the antibody, the hinge region influences the ability of the antibody to activate the cascade. For example, recombinant immunoglobulins lacking a hinge region are unable to activate complement. (Shin et al., 1992) Without the flexibility conferred by the hinge region, the Fab portion of the antibody bound to the antigen may not be able to adopt the conformation required to permit C1q to bind to CH2. (See id.) Hinge length and segmental flexibility have been correlated with complement activation; however, the correlation is not absolute. Human IgG3 molecules with altered hinge regions that are as rigid as IgG4 can still effectively activate the cascade.

The absence of a hinge region, or a lack of a functional hinge region, can also affect the ability of certain human IgG immunoglobulins to bind Fc receptors on immune effector cells. Binding of an immunoglobulin to an Fc receptor facilitates antibody-dependent cell-mediated cytotoxicity (ADCC), which is presumed to be an important mechanism for the elimination of tumor cells. The human IgG Fc receptor (FcR) family is divided into three groups, FcγRI (CD64), which is capable of binding IgG with high affinity, and FcγRII (CD32) and FcγRIII (CD16), both of which are low affinity receptors. The molecular interaction between each of the three receptors and an immunoglobulin has not been defined precisely, but experimental evidence indicates that residues in the hinge proximal region of the CH2 domain are important to the specificity of the interaction between the antibody and the Fc receptor. In addition, IgG1 myeloma proteins and recombinant IgG3 chimeric antibodies that lack a hinge region are unable to bind FcγRI, likely because accessibility to CH2 is decreased. (Shin et al., *Intern. Rev. Immunol.* 10:177, 178-79 (1993)).

Unusual and apparently evolutionarily unrelated exceptions to the $H_2L_2$ structure of conventional antibodies occur in some isotypes of the immunoglobulins found in camelids (Hamers-Casterman et al., 1993 *Nature* 363:446; Nguyen et al., 1998 *J. Mol. Biol.* 275:413) and in nurse sharks (Roux et al., 1998 *Proc. Nat. Acad. Sci. USA* 95:11804). These antibodies form their antigen-binding pocket using the heavy chain variable region alone. In both species, these variable regions often contain an extended third complementarity determining region (CDR3) to help compensate for the lack of a light chain variable region, and there are frequent disulfide bonds between CDR regions to help stabilize the binding site [Muyldermans et al., 1994 *Prot. Engineer.* 7:1129; Roux et al., 1998]. However, the function of the heavy chain-only antibodies is unknown, and the evolutionary pressure leading to their formation has not been identified. Since camelids, including camels, llamas, and alpacas, also express conventional $H_2L_2$ antibodies, the heavy chain-only antibodies do not appear to be present in these animals simply as an alternative antibody structure.

Variable regions ($V_H$H) of the camelid heavy chain-only immunoglobulins contain amino acid substitutions at several positions outside of the CDR regions when compared with conventional ($H_2L_2$) heavy chain variable regions. These amino acid substitutions are encoded in the germ line [Nguyen et al., 1998 *J. Mol. Biol.* 275:413] and are located at residues that normally form the hydrophobic interface between conventional $V_H$ and $V_L$ domains [Muyldermans et al., 1994 *Prot. Engineer.* 7:1129]. Camelid $V_H$H recombine with IgG2 and IgG3 constant regions that contain hinge, CH2, and CH3 domains but which lack a CH1 domain [Hamers-Casterman et al., 1993 *Nature* 363:446]. Interestingly, $V_H$H are encoded by a chromosomal locus distinct from the $V_H$ locus [Nguyen, 1998], indicating that camelid B cells have evolved complex mechanisms of antigen recognition and differentiation. Thus, for example, llama IgG1 is a conventional ($H_2L_2$) antibody isotype in which $V_H$ recombines with a constant region that contains hinge, CH1, CH2 and CH3 domains, whereas the llama IgG2 and IgG3 are heavy chain-only isotypes that lack CH1 domains and that contain no light chains.

Monoclonal antibody technology and genetic engineering methods have led to rapid development of immunoglobulin molecules for diagnosis and treatment of human diseases. Protein engineering has been applied to improve the affinity of an antibody for its cognate antigen, to diminish problems related to immunogenicity of administered recombinant polypeptides, and to alter antibody effector functions. The domain structure of immunoglobulins is amenable to recombinant engineering, in that the antigen binding domains and the domains conferring effector functions may be exchanged between immunoglobulin classes (e.g., IgG, IgA, IgE) and subclasses (e.g., IgG1, IgG2, IgG3, etc.).

In addition, smaller immunoglobulin molecules have been constructed to overcome problems associated with whole immunoglobulin therapy. For instance, single chain immunoglobulin variable region fragment polypeptides (scFv) comprise an immunoglobulin heavy chain variable domain joined via a short linker peptide to an immunoglobulin light chain variable domain (Huston et al. *Proc. Natl. Acad. Sci. USA*, 85: 5879-83, 1988). Because of the small size of scFv molecules, they exhibit very rapid clearance from plasma and tissues and are capable of more effective penetration into tissues than whole immunoglobulins. (see, e.g., Jain, 1990 *Cancer Res.* 50:814s-819s.) An anti-tumor scFv showed more rapid tumor penetration and more even distribution through the tumor mass than the corresponding chimeric antibody (Yokota et al., *Cancer Res.* 52, 3402-08 (1992)). Fusion of an scFv to another molecule, such as a toxin, takes advantage of the specific antigen-binding activity and the small size of an scFv to deliver the toxin to a target tissue. (Chaudary et al., *Nature* 339:394 (1989); Batra et al., *Mol. Cell. Biol.* 11:2200 (1991)).

Despite the advantages that scFv molecules bring to serotherapy, several drawbacks to this therapeutic approach exist. While rapid clearance of scFv may reduce toxic effects in normal cells, such rapid clearance may prevent delivery of a minimum effective dose to the target tissue. Manufacturing adequate amounts of scFv for administration to patients has been challenging due to difficulties in expression and isolation of scFv that adversely affect the yield. During expression, scFv molecules lack stability and often aggregate due to pairing of variable regions from different molecules. Furthermore, production levels of scFv molecules in mammalian expression systems are low, limiting the potential for efficient manufacturing of scFv molecules for therapy (Davis et al, *J. Biol. Chem.* 265:10410-18 (1990); Traunecker et al., *EMBO J.* 10: 3655-59 (1991)). Strategies for improving production have been explored, including addition of glycosylation sites to the variable regions (e.g., U.S. Pat. No. 5,888,773; Jost et al, *J. Biol. Chem.* 269: 26267-73 (1994)).

An additional disadvantage to using scFv for therapy is the lack of effector function. An scFv that lacks the cytolytic functions, ADCC and complement dependent-cytotoxicity (CDC), which are typically associated with immunoglobulin constant regions, may be ineffective for treating disease. Even though development of scFv technology began over 12 years ago, currently no scFv products are approved for therapy. Conjugation or fusion of toxins to scFv has thus been an alternative strategy to provide a potent, antigen-specific molecule, but dosing with such conjugates or chimeras is often limited by excessive and/or non-specific toxicity having its origin in the toxin moiety of such preparations. Toxic effects may include supraphysiological elevation of liver enzymes and vascular leak syndrome, and other undesired effects. In addition, immunotoxins are themselves highly immunogenic after being administered to a host, and host antibodies generated against the immunotoxin limit its potential usefulness in repeated therapeutic treatments of an individual.

The benefits of immunoglobulin constant region-associated effector functions in the treatment of disease has prompted development of fusion proteins in which immunoglobulin constant region polypeptide sequences are present and nonimmunoglobulin sequences are substituted for the antibody variable region. For example, CD4, the T cell surface protein recognized by HIV, was recombinantly fused to an immunoglobulin Fc effector domain. (See Sensel et al., *Chem. Immunol.* 65:129-158 (1997)). The biological activity of such a molecule will depend in part on the class or subclass of the constant region chosen. An IL-2-IgG1 fusion protein effected complement-mediated lysis of IL-2 receptor-bearing cells. (See id.). Use of immunoglobulin constant regions to construct these and other fusion proteins may also confer improved pharmacokinetic properties.

Diseases and disorders thought to be amenable to some type of immunoglobulin therapy include cancer and immune system disorders. Cancer includes a broad range of diseases, affecting approximately one in four individuals worldwide. Rapid and unregulated proliferation of malignant cells is a hallmark of many types of cancer, including hematological malignancies. Patients with a hematologic malignant condition have benefited most from advances in cancer therapy in the past two decades (Multani et al., *J. Clin. Oncology* 16: 3691-3710, 1998). Although remission rates have increased, most patients still relapse and succumb to their disease. Barriers to cure with cytotoxic drugs include tumor cell resistance and the high toxicity of chemotherapy, which prevents optimal dosing in many patients. New treatments based on targeting with molecules that specifically bind to a malignant cell, including monoclonal antibodies (mAbs), can improve effectiveness without increasing toxicity.

Since monoclonal antibodies (mAb) were first described in 1975 (Kohler et al., *Nature* 256:495-97 (1975)), many patients have been treated with mAbs that specifically bind to tumor antigens, or antigens expressed on tumor cells. These studies have yielded important lessons regarding the selection of tumor cell surface antigens that are tumor antigens suitable for use as immunotherapy targets. First, it is highly preferable that such a target antigen is not expressed by normal tissues the preservation of which is important to host survival. Fortunately, in the case of hematologic malignancy, malignant cells express many antigens that are not expressed on the surfaces of stem cells or other essential cells. Treatment of a hematologic malignant condition using a therapeutic regimen that depletes both normal and malignant cells of hematological origin has been acceptable where regeneration of normal cells from progenitors can occur after therapy has ended. Second, the target antigen should be expressed on all or virtually all clonogenic populations of tumor cells, and expression should persist despite the selective pressure from immunoglobulin therapy. Thus, a strategy that employs selection of a cell surface idiotype (e.g., a particular idiotope) as a target for therapy of B cell malignancy has been limited by the outgrowth of tumor cell variants with altered surface idiotype expression, even where the antigen exhibits a high degree of tumor selectivity (Meeker et al., *N. Engl. J. Med.* 312:1658-65 (1985)). Third, the selected antigen must traffic properly after an immunoglobulin binds to it. Shedding or internalization of a cell surface target antigen after an immunoglobulin binds to the antigen may allow tumor cells to escape destruction, thus limiting the effectiveness of serotherapy. Fourth, binding of an immunoglobulin to cell surface target antigens that transmit or transduce cellular activation signals may result in improved functional responses to immunotherapy in tumor cells, and can lead to growth arrest and/or apoptosis. While all of these properties are important, the triggering of apoptosis after an immunoglobulin binds to the target antigen may be a critical factor in achieving successful serotherapy.

Antigens that have been tested as targets for serotherapy of B and T cell malignancies include Ig idiotype (Brown et al., *Blood* 73:651-61 (1989)), CD19 (Hekman et al., *Cancer Immunol. Immunother.* 32:364-72 (1991); Vlasveld et al., *Cancer Immunol. Immunother.* 40: 37-47 (1995)), CD20 (Press et al., *Blood* 69: 584-91 (1987); Maloney et al., *J. Clin. Oncol.* 15:3266-74, (1997)) CD21 (Scheinberg et. al., *J. Clin. Oncol.* 8:792-803, (1990)), CD5 (Dillman et. al., *J. Biol. Respn. Mod.* 5:394-410 (1986)), and CD52 (CAMPATH) (Pawson et al., *J. Clin. Oncol.* 15:2667-72, (1997)). Of these, the most success has been obtained using CD20 as a target for therapy of B cell lymphomas. Each of the other targets has been limited by the biological properties of the antigen. For example, surface idiotype can be altered through somatic mutation, allowing tumor cell escape. As other examples, CD5, CD21, and CD19 are rapidly internalized after mAb binding, allowing tumor cells to escape destruction unless mAbs are conjugated with toxin molecules. CD22 is expressed on only a subset of B cell lymphomas, thereby limiting its usefulness, while CD52 is expressed on both T cells and B cells and may therefore generate counterproductive immunosuppression by effecting selective T cell depletion.

CD20 fulfills the basic criteria described above for selection of an appropriate target antigen for therapy of a B cell malignant condition. Treatment of patients with low grade or follicular B cell lymphoma using chimeric CD20 mAb induces partial or complete responses in many patients (McLaughlin et al, *Blood* 88:90a (abstract, suppl. 1) (1996); Maloney et al, *Blood* 90: 2188-95 (1997)). However, tumor relapse commonly occurs within six months to one year. Therefore, further improvements in serotherapy are needed to induce more durable responses in low grade B cell lymphoma, and to allow effective treatment of high grade lymphoma and other B cell diseases.

One approach to improving CD20 serotherapy has been to target radioisotopes to B cell lymphomas using mAbs specific for CD20. While the effectiveness of therapy is increased, associated toxicity from the long in vivo half-life of the radioactive antibody increases also, sometimes requiring that the patient undergo stem cell rescue (Press et al., *N. Eng. J. Med.* 329: 1219-1224, 1993; Kaminski et al., N. Eng. J. Med. 329:459-65 (1993)). MAbs to CD20 have been cleaved with proteases to yield $F(ab')_2$ or Fab fragments prior to attachment of the radioisotope. This improves penetration of the radioisotope conjugate into the tumor, and shortens the in vivo half-life, thus reducing the toxicity to normal tissues. However, the advantages of effector functions, including complement fixation and/or ADCC that would otherwise be provided by the Fc region of the CD20 mAb, are lost since the Fab preparations lack immunoglobulin Fc domains. Therefore, for improved delivery of radioisotopes, a strategy is needed to make a CD20 mAb derivative that retains Fc-dependent effector functions but which is smaller in size, thereby increasing tumor penetration and shortening mAb half-life.

CD20 was the first human B cell lineage-specific surface molecule identified by a monoclonal antibody, but the function of CD20 in B cell biology is still incompletely understood. CD20 is a non-glycosylated, hydrophobic 35 kDa B cell transmembrane phosphoprotein that has both amino and carboxy ends situated in the cytoplasm (Einfeld et al, *EMBO J.* 7:711-17 (1988)). Natural ligands for CD20 have not been identified. CD20 is expressed by all normal mature B cells, but is not expressed by precursor B cells.

CD20 mAbs deliver signals to normal B cells that affect viability and growth (Clark et al., *Proc. Natl. Acad. Sci. USA* 83:4494-98 (1986)), and extensive cross-linking of CD20 can induce apoptosis in B lymphoma cell lines (Shan et al., *Blood* 91:1644-52 (1998)). Cross-linking of CD20 on the cell surface increases the magnitude and enhances the kinetics of signal transduction, for example, as detected by measuring tyrosine phosphorylation of cellular substrates (Deans et al., *J. Immunol.* 146:846-53 (1993)). Significantly, apoptosis in Ramos B lymphoma cells can also be induced by FcR cross-linking CD20 mAbs bound to the Ramos cell surfaces, by the addition of Fc-receptor positive cells (Shan et al., *Blood* 91: 1644-52 (1998)). Therefore, in addition to cellular depletion by complement and ADCC mechanisms, Fc-receptor binding by CD20 mAbs in vivo can promote apoptosis of malignant B cells by CD20 cross-linking. This theory is consistent with experiments showing that effectiveness of CD20 therapy of human lymphoma in a SCID mouse model was dependent upon Fc-receptor binding by the CD20 mAb (Funakoshi et al., *J. Immunotherapy* 19:93-101 (1996)).

The CD20 polypeptide contains four transmembrane domains (Einfeld et al., *EMBO J.* 7: 711-17, (1988); Stamenkovic et al., *J. Exp. Med.* 167:1975-80 (1988); Tedder et. al., *J. Immunol.* 141:4388-4394 (1988)). The multiple membrane spanning domains prevent CD20 internalization after antibody binding. This property of CD20 was recognized as an important feature for effective therapy of B cell malignancies when a murine CD20 mAb, 1F5, was injected into patients with B cell lymphoma, resulting in significant depletion of malignant cells and partial clinical responses (Press et al., *Blood* 69: 584-91 (1987)).

Because normal mature B cells also express CD20, normal B cells are depleted during CD20 antibody therapy (Reff, M. E. et al, *Blood* 83: 435-445, 1994). However, after treatment is completed, normal B cells are regenerated from CD20 negative B cell precursors; therefore, patients treated with anti-CD20 therapy do not experience significant immunosuppression. Depletion of normal B cells may be beneficial in diseases that involve inappropriate production of autoantibodies or other diseases where B cells may play a role. A chimeric mAb specific for CD20, consisting of heavy and light chain variable regions of mouse origin fused to human IgG1 heavy chain and h an kappa light chain constant regions, retained binding to CD20 and the ability to mediate ADCC and to fix complement (Liu et al., J. Immunol. 139:3521-26 (1987); Robinson et al., U.S. Pat. No. 5,500,362). This work led to development of a chimeric CD20 mAb, rituximab, currently approved by the U.S. Food and Drug Administration for approval for therapy of B cell lymphomas. While clinical responses are frequently observed after treatment with rituximab, patients often relapse after about 6-12 months.

High doses of rituximab are required for intravenous injection because the molecule is large, approximately 150 kDa, and diffusion is limited into the lymphoid tissues where many tumor cells reside. The mechanism of anti-tumor activity of rituximab is thought to be a combination of several activities, including ADCC, fixation of complement, and triggering of signals in malignant B cells that promote apoptosis. The large size of rituximab prevents optimal diffusion of the molecule into lymphoid tissues that contain malignant B cells, thereby limiting these anti-tumor activities. As discussed above, cleavage of CD20 mAbs with proteases into Fab or F(ab')$_2$ fragments makes them smaller and allows better penetration into lymphoid tissues, but the effector functions important for anti-tumor activity are lost. While CD20 mAb fragments may be more effective than intact antibody for delivery of radioisotopes, it would be desirable to construct a CD20 mAb derivative that retains the effector functions of the Fc portion, but is smaller in size, facilitating better tumor penetration and resulting in a shorter half-life.

CD20 is expressed by many malignant cells of B cell origin, including B cell lymphoma and chronic lymphocytic leukemia (CLL). CD20 is not expressed by malignancies of pre-B cells, such as acute lymphoblastic leukemia. CD20 is therefore a good target for therapy of B cell lymphoma, CLL, and other diseases in which B cells are involved in the pathogenesis and/or progression of disease. Other B cell disorders include autoimmune diseases in which autoantibodies are produced during or after the differentiation of B cells into plasma cells. Examples of B cell disorders include autoimmune thyroid disease, including Graves' disease and Hashimoto's thyroiditis, rheumatoid arthritis, systemic lupus erythematosus (SLE), Sjogrens syndrome, immune thrombocytopenic purpura (ITP), multiple sclerosis (MS), myasthenia gravis (MG), psoriasis, scleroderma, and inflammatory bowel disease, including Crohn's disease and ulcerative colitis.

In view of the foregoing, there is clearly a need for improved compositions and methods to treat malignant conditions in general, and in particular B cell disorders. As described in greater detail herein, the compositions and methods of the present invention overcome the limitations of the prior art by providing a binding domain-immunoglobulin fusion protein that specifically binds to an antigen and that is capable of mediating ADCC or complement fixation. Furthermore, the compositions and methods offer other related advantages.

SUMMARY OF THE INVENTION

It is an aspect of the present invention to provide a binding domain-immunoglobulin fusion protein, comprising (a) a binding domain polypeptide that is fused to an immunoglobulin hinge region polypeptide, wherein said hinge region polypeptide is selected from the group consisting of (i) a wild-type human IgG1 immunoglobulin hinge region polypeptide, (ii) a mutated human IgG1 immunoglobulin hinge region polypeptide that is derived from a wild-type immunoglobulin hinge region polypeptide having three or more cysteine residues, wherein said mutated human IgG1 immunoglobulin hinge region polypeptide contains two cysteine residues and wherein a first cysteine of the wild-type hinge region is not mutated, (iii) a mutated human IgG1 immunoglobulin hinge region polypeptide that is derived from a wild-type immunoglobulin hinge region polypeptide having three or more cysteine residues, wherein said mutated human IgG1 immunoglobulin hinge region polypeptide contains no more than one cysteine residue, and (iv) a mutated human IgG1 immunoglobulin hinge region polypeptide that is derived from a wild-type immunoglobulin hinge region polypeptide having three or more cysteine residues, wherein said mutated human IgG1 immunoglobulin hinge region polypeptide contains no cysteine residues; (b) an immunoglobulin heavy chain CH2 constant region polypeptide that is fused to the hinge region polypeptide; and (c) an immunoglobulin heavy chain CH3 constant region polypeptide that is fused to the CH2 constant region polypeptide, wherein (1) the binding domain-immunoglobulin fusion protein is capable of at least one immunological activity selected from the group consisting of antibody dependent cell-mediated cytotoxicity and complement fixation, and (2) the binding domain polypeptide is capable of specifically binding to an antigen.

In certain embodiments the immunoglobulin hinge region polypeptide is a mutated hinge region polypeptide and exhibits a reduced ability to dimerize, relative to a wild-type human immunoglobulin G hinge region polypeptide. In certain embodiments the binding domain polypeptide comprises at least one immunoglobulin variable region polypeptide that is selected an immunoglobulin light chain variable region polypeptide or an immunoglobulin heavy chain variable region polypeptide. In certain further embodiments the binding domain-immunoglobulin fusion protein comprises an immunoglobulin heavy chain variable region polypeptide, wherein the heavy chain variable region polypeptide is a human immunoglobulin heavy chain variable region polypeptide comprising a mutation at an amino acid at a location corresponding to amino acid position 11 in the VH domain, or amino acid position 155 in SEQ ID NO: 11, position 158 in SEQ ID NO: 12, position 154 in SEQ ID NO:13, or position 159 in SEQ ID NO 14, or amino acid position 11 in the VH domain polypeptides listed in SEQ ID NOS: 341, 354, 465, 471, 477, 548. In certain embodiments the immunoglobulin variable region polypeptide is derived from a human immunoglobulin, and in certain other embodiments the immunoglobulin variable region polypeptide comprises a humanized immunoglobulin polypeptide sequence. In certain embodiments the immunoglobulin variable region polypeptide is derived from a murine immunoglobulin.

According to certain embodiments of the present invention, the binding domain polypeptide comprises (a) at least one immunoglobulin light chain variable region polypeptide; (b) at least one immunoglobulin heavy chain variable region polypeptide; and (c) at least one linker polypeptide that is fused to the polypeptide of (a) and to the polypeptide of (b). In certain further embodiments the immunoglobulin light chain variable region and heavy chain variable region polypeptides are derived from human immunoglobulins, and in certain other further embodiments the linker polypeptide comprises at least one polypeptide having as an amino acid sequence Gly-Gly-Gly-Gly-Ser [SEQ ID NO: 39]. In other embodiments the linker polypeptide comprises at least three repeats of a polypeptide having as an amino acid sequence Gly-Gly-Gly-Gly-Ser [SEQ ID NO: 39]. In other embodiments the linker comprises a glycosylation site, which in certain further embodiments is an asparagine-linked glycosylation site, an O-linked glycosylation site, a C-mannosylation site, a glypiation site or a phosphoglycation site. In another embodiment at least one of the immunoglobulin heavy chain CH2 constant region polypeptide and the immunoglobulin heavy chain CH3 constant region polypeptide is derived from a human immunoglobulin heavy chain. In another embodiment the immunoglobulin heavy chain constant region CH2 and CH3 polypeptides are of an isotype that is human IgG or human IgA. In certain other embodiments the antigen is CD19, CD20, CD22, CD37, CD40, L6, CD2, CD28, CD30, CD40, CD50 (ICAM3), CD54 (ICAM1), CD80, CD86, B7-H1, CD134 (OX40), CD137 (41BB), CD152 (CTLA-4), CD153 (CD30 ligand), CD154 (CD40 ligand), ICOS, CD19, CD3, CD4, CD25, CD8, CD11b, CD14, CD25, CD56 or CD69. In another embodiment the binding domain polypeptide comprises a CD154 extracellular domain. In still another embodiment the binding domain polypeptide comprises a CD154 extracellular domain and at least one immunoglobulin variable region polypeptide. In another embodiment the binding domain polypeptide comprises a CTLA-4 extracellular domain, and in further embodiments at least one of the immunoglobulin heavy chain constant region polypeptides selected from a CH2 constant region polypeptide and a CH3 constant region polypeptide is a human IgG1 constant region polypeptide. In another further embodiment at least one of the immunoglobulin heavy chain constant region polypeptides selected from a CH2 constant region polypeptide and a CH3 constant region polypeptide is a human IgA constant region polypeptide.

Turning to another embodiment, the present invention provides a binding domain-immunoglobulin fusion protein, comprising (a) a binding domain polypeptide that is fused to an immunoglobulin hinge region polypeptide; (b) an immunoglobulin heavy chain CH2 constant region polypeptide that is fused to the hinge region polypeptide; and (c) an immunoglobulin heavy chain CH3 constant region polypeptide that is fused to the CH2 constant region polypeptide, wherein (1) the binding domain polypeptide comprises a CTLA-4 extracellular domain that is capable of specifically binding to at least one CTLA-4 ligand selected from the group consisting of CD80 and CD86, (2) the immunoglobulin hinge region polypeptide comprises a polypeptide that is selected from the group consisting of a human IgA hinge region polypeptide and a human IgG1 hinge region polypeptide, (3) the immunoglobulin heavy chain CH2 constant region polypeptide comprises a polypeptide that is selected from the group consisting of a human IgA heavy chain CH2 constant region polypeptide and a human IgG1 heavy chain CH2 constant region polypeptide, (4) the immunoglobulin heavy chain CH3 constant region polypeptide comprises a polypeptide that is selected from the group consisting of a human IgA heavy chain CH3 constant region polypeptide and a human IgG1 heavy chain CH3 constant region polypeptide, and (5) the binding domain-immunoglobulin fusion protein is capable of at least one immunological activity selected from the group consisting of antibody dependent cell-mediated cytotoxicity and complement fixation.

In another embodiment the present invention provides a binding domain-immunoglobulin fusion protein, comprising (a) a binding domain polypeptide that is fused to an immunoglobulin hinge region polypeptide, wherein said hinge region polypeptide comprises a human IgE hinge region polypeptide; (b) an immunoglobulin heavy chain CH2 constant region polypeptide that is fused to the hinge region polypeptide, wherein said CH2 constant region polypeptide comprises a human IgE CH2 constant region polypeptide; and (c) an immunoglobulin heavy chain CH3 constant region polypeptide that is fused to the CH2 constant region polypeptide, wherein said CH3 constant region polypeptide comprises a human IgE CH3 constant region polypeptide wherein (1) the binding domain-immunoglobulin fusion protein is capable of at least one immunological activity selected from antibody dependent cell-mediated cytotoxicity and induction of an allergic response mechanism, and (2) the binding domain polypeptide is capable of specifically binding to an antigen. In a further embodiment the binding domain-immunoglobulin fusion protein comprises a human IgE CH4 constant region polypeptide. In another further embodiment the antigen is a tumor antigen.

In certain other embodiments the present invention provides a binding domain-immunoglobulin fusion protein, comprising (a) a binding domain polypeptide that is fused to an immunoglobulin hinge region polypeptide, wherein the binding domain polypeptide is capable of specifically binding to at least one antigen that is present on an immune effector cell and wherein the hinge region polypeptide comprises a polypeptide selected from the group consisting of a human IgA hinge region polypeptide, a human IgG hinge region polypeptide, and a human IgE hinge region polypeptide; (b) an immunoglobulin heavy chain CH2 constant region polypeptide that is fused to the hinge region polypeptide, wherein said CH2 constant region polypeptide comprises a polypeptide selected from the group consisting of a human IgA CH2 constant region polypeptide, a human IgG CH2 constant region polypeptide, and a human IgE CH2 constant region polypeptide; (c) an immunoglobulin heavy chain CH3 constant region polypeptide that is fused to the CH2 constant region polypeptide, wherein said CH3 constant region polypeptide comprises a polypeptide selected from the group consisting of a human IgA CH3 constant region polypeptide, a human IgG CH3 constant region polypeptide, and a human IgE CH3 constant region polypeptide; and (d) a plasma membrane anchor domain polypeptide. In a further embodiment the membrane anchor domain polypeptide comprises a transmembrane domain polypeptide. In another further embodiment the membrane anchor domain polypeptide comprises a transmembrane domain polypeptide and a cytoplasmic tail polypeptide. In a still further embodiment the cytoplasmic tail polypeptide comprises an apoptosis signaling polypeptide sequence, which in a still further embodiment is derived from a receptor death domain polypeptide. In a further embodiment the death domain polypeptide comprises a polypeptide selected from an ITIM domain, an ITAM domain, FADD, TRADD, RAIDD, CD95 (FAS/Apo-1), TNFR1 or DR5. In another embodiment the apoptosis signaling polypeptide sequence comprises a polypeptide sequence derived from a caspase polypeptide that is caspase-3 or caspase-8. In another embodiment the plasma membrane anchor domain polypeptide comprises a glycosyl-phosphatidylinositol-linkage polypeptide sequence. In another embodiment the antigen that is present on an immune effector cell is CD2, CD28, CD30, CD40, CD50 (ICAM3), CD54 (ICAM1), CD80, CD86, B7-H1, CD134 (OX40), CD137 (41BB), CD152 (CTLA-4), CD153 (CD30 ligand), CD154 (CD40 ligand), ICOS, CD19, CD20, CD22, CD37, L6, CD3, CD4, CD25, CD8, CD11b, CD14, CD25, CD56 or CD69. In another embodiment the human IgG is human IgG1.

The invention provides, in another embodiment, a binding domain-immunoglobulin fusion protein, comprising (a) a binding domain polypeptide that is fused to an immunoglobulin hinge region polypeptide, wherein the binding domain polypeptide is capable of specifically binding to at least one antigen that is present on a cancer cell surface and wherein the hinge region polypeptide comprises a polypeptide selected from the group consisting of a human IgA hinge region polypeptide, a human IgG hinge region polypeptide, and a human IgE hinge region polypeptide; (b) an immunoglobulin heavy chain CH2 constant region polypeptide that is fused to the hinge region polypeptide, wherein the CH2 constant region polypeptide comprises a polypeptide that is a human IgA CH2 constant region polypeptide, a human IgG CH2 constant region polypeptide, or a human IgE CH2 constant region polypeptide; (c) an immunoglobulin heavy chain CH3 constant region polypeptide that is fused to the CH2 constant region polypeptide, wherein the CH3 constant region polypeptide comprises a polypeptide that is a human IgA CH3 constant region polypeptide, a human IgG CH3 constant region polypeptide, or a human IgE CH3 constant region polypeptide; and (d) a plasma membrane anchor domain polypeptide. In a further embodiment the membrane anchor domain polypeptide comprises a transmembrane domain polypeptide. In another embodiment the membrane anchor domain polypeptide comprises a transmembrane domain polypeptide and a cytoplasmic tail polypeptide. In another embodiment the membrane anchor domain polypeptide comprises a glycosyl-phosphatidylinositol-linkage polypeptide sequence. In another embodiment the human IgG is human IgG1.

In another embodiment the present invention provides a binding domain-immunoglobulin fusion protein, comprising (a) a binding domain polypeptide that is fused to an immunoglobulin hinge region polypeptide, wherein said hinge region polypeptide comprises a wild-type human IgA hinge region polypeptide; (b) an immunoglobulin heavy chain CH2 constant region polypeptide that is fused to the hinge region polypeptide, wherein said CH2 constant region polypeptide comprises a human IgA CH2 constant region polypeptide; and (c) an immunoglobulin heavy chain CH3 constant region polypeptide that is fused to the CH2 constant region polypeptide, wherein the CH3 constant region polypeptide comprises a polypeptide that is (i) a wild-type human IgA CH3 constant region polypeptide or (ii) a mutated human IgA CH3 constant region polypeptide that is incapable of associating with a J chain, wherein (1) the binding domain-immunoglobulin fusion protein is capable of at least one immunological activity selected from the group consisting of antibody dependent cell-mediated cytotoxicity and complement fixation, and (2) the binding domain polypeptide is capable of specifically binding to an antigen. In certain further embodiments the mutated human IgA CH3 constant region polypeptide that is incapable of associating with a J chain is (i) a polypeptide comprising an amino acid sequence as set forth in SEQ ID NOS: 296, 511AA or 295 and 510 (DNA) or (ii) a polypeptide comprising an amino acid sequence as set forth in SEQ ID NO: 303, 520 for amino acid sequence, and (302, 519 for DNA).

In certain other embodiments the present invention provides a binding domain-immunoglobulin fusion protein, comprising (a) a binding domain polypeptide that is fused to an immunoglobulin hinge region polypeptide; (b) an immunoglobulin heavy chain CH2 constant region polypeptide that is fused to the hinge region polypeptide, wherein the CH2 constant region polypeptide comprises a llama CH2 constant region polypeptide that is a llama IgG1 CH2 constant region polypeptide, a llama IgG2 CH2 constant region polypeptide or a llama IgG3 CH2 constant region polypeptide; and (c) an immunoglobulin heavy chain CH3 constant region polypeptide that is fused to the CH2 constant region polypeptide, wherein said CH3 constant region polypeptide comprises a llama CH3 constant region polypeptide that is selected from the group consisting of a llama IgG1 CH3 constant region polypeptide, a llama IgG2 CH3 constant region polypeptide and a llama IgG3 CH3 constant region polypeptide wherein (1) the binding domain-immunoglobulin fusion protein is capable of at least one immunological activity selected from the group consisting of antibody dependent cell-mediated cytotoxicity and induction fixation of complement, and (2) the binding domain polypeptide is capable of specifically binding to an antigen. In a further embodiment the immunoglobulin hinge region polypeptide, the llama CH2 constant region polypeptide and the llama CH3 constant region polypeptide comprise sequences derived from a llama IgG1 polypeptide and the fusion protein does not include a llama IgG1 CH1 domain. In certain embodiments the invention provides any of the above described binding domain-immunoglobulin fusion proteins wherein the hinge region polypeptide is mutated to contain a glycosylation site, which in certain further embodiments is an asparagine-linked glycosylation site, an O-linked glycosylation site, a C-mannosylation site, a glypiation site or a phosphoglycation site. In certain embodiments the invention provides any of the above described binding domain-immunoglobulin fusion proteins wherein the binding domain polypeptide comprises two or more binding domain polypeptide sequences wherein each of the binding domain polypeptide sequences is capable of specifically binding to an antigen.

The present invention also provides, in certain embodiments, a binding domain-immunoglobulin fusion protein, comprising (a) a binding domain polypeptide that is fused to an immunoglobulin hinge region polypeptide, wherein the hinge region polypeptide comprises an alternative hinge region polypeptide sequence; (b) an immunoglobulin heavy chain CH2 constant region polypeptide that is fused to the hinge region polypeptide; and (c) an immunoglobulin heavy chain CH3 constant region polypeptide that is fused to the CH2 constant region polypeptide, wherein: (1) the binding domain-immunoglobulin fusion protein is capable of at least one immunological activity selected from the group consisting of antibody dependent cell-mediated cytotoxicity and complement fixation, and (2) the binding domain polypeptide is capable of specifically binding to an antigen.

Turning to another embodiment there is provided a binding domain-immunoglobulin fusion protein, comprising (a) a binding domain polypeptide that is fused to an immunoglobulin hinge region polypeptide, wherein the binding domain polypeptide is capable of specifically binding to at least one antigen that is present on a cancer cell surface and wherein the hinge region polypeptide comprises an alternative hinge region polypeptide sequence; (b) an immunoglobulin heavy chain CH2 constant region polypeptide that is fused to the hinge region polypeptide, wherein said CH2 constant region polypeptide comprises a polypeptide selected from the group consisting of a human IgA CH2 constant region polypeptide, a human IgG CH2 constant region polypeptide, and a human IgE CH2 constant region polypeptide; (c) an immunoglobulin heavy chain CH3 constant region polypeptide that is fused to the CH2 constant region polypeptide, wherein the CH3 constant region polypeptide comprises a polypeptide that is a human IgA CH3 constant region polypeptide, a human IgG CH3 constant region polypeptide, or a human IgE CH3 constant region polypeptide; and (d) a plasma membrane anchor domain polypeptide. In certain further embodiments the alternative hinge region polypeptide sequence comprises a polypeptide sequence of at least ten continuous amino acids that are present in a sequence selected from SEQ ID NOS: 215, 216, 217, 218, 223, 224, 6, 15, 16. 35, 36, 37, 41, 207, 208, 223, 275, 276, 277, 296, 300, 350, 390, 391, 392, 396, 397, 398, 488, 582, 584, 586.

In certain embodiments the present invention provides an isolated polynucleotide encoding any one of the above described binding domain-immunoglobulin fusion proteins, and in other embodiments the invention provides a recombinant expression construct comprising any such polynucleotide that is operably linked to a promoter. In other embodiments there is provided a host cell transformed or transfected with any such recombinant expression construct. In a related embodiment there is provided a method of producing a binding domain-immunoglobulin fusion protein, comprising the steps of (a) culturing a host cell as just described under conditions that permit expression of the binding domain-immunoglobulin fusion protein; and (b) isolating the binding domain-immunoglobulin fusion protein from the host cell culture. In another embodiment there is provided a pharmaceutical composition comprising any one of the above described binding domain-immunoglobulin fusion proteins in combination with a physiologically acceptable carrier. In another embodiment the invention provides a pharmaceutical composition comprising an isolated polynucleotide encoding any one of the above described binding domain-immunoglobulin fusion proteins, in combination with a physiologically acceptable carrier. In another embodiment the invention provides a method of treating a subject having or suspected of having a malignant condition or a B-cell disorder, comprising administering to a patient a therapeutically effective amount of any of the pharmaceutical compositions just described. In certain further embodiments the malignant condition or B-cell disorder is a B-cell lymphoma or a disease characterized by autoantibody production, and in certain other further embodiments the malignant condition or B-cell disorder is rheumatoid arthritis, myasthenia gravis, Grave's disease, type I diabetes mellitus, multiple sclerosis or an autoimmune disease. In certain other embodiments the malignant condition is melanoma, carcinoma or sarcoma.

It is another aspect of the present invention to provide a binding domain-immunoglobulin fusion protein, comprising (a) a binding domain polypeptide that is fused to an immunoglobulin hinge region polypeptide, wherein said hinge region polypeptide is selected from the group consisting of (i) a mutated hinge region polypeptide that contains no cysteine residues and that is derived from a wild-type immunoglobulin hinge region polypeptide having one or more cysteine residues, (ii) a mutated hinge region polypeptide that contains one cysteine residue and that is derived from a wild-type immunoglobulin hinge region polypeptide having two or more cysteine residues, (iii) a wild-type human IgA hinge region polypeptide, (iv) a mutated human IgA hinge region polypeptide that contains no cysteine residues and that is derived from a wild-type human IgA region polypeptide, and (v) a mutated human IgA hinge region polypeptide that contains one cysteine residue and that is derived from a wild-type human IgA region polypeptide; (b) an immunoglobulin heavy chain CH2 constant region polypeptide that is fused to the hinge region polypeptide; and (c) an immunoglobulin heavy chain CH3 constant region polypeptide that is fused to the CH2 constant region polypeptide, wherein: (1) the binding domain-immunoglobulin fusion protein is capable of at least one immunological activity selected from the group consisting of antibody dependent cell-mediated cytotoxicity and complement fixation, and (2) the binding domain polypeptide is capable of specifically binding to an antigen. In one embodiment the immunoglobulin hinge region polypeptide is a mutated hinge region polypeptide and exhibits a reduced ability to dimerize, relative to a wild-type human immunoglobulin G hinge region polypeptide. In another embodiment the binding domain polypeptide comprises at least one immunoglobulin variable region polypeptide that is an immunoglobulin light chain variable region polypeptide or an immunoglobulin heavy chain variable region polypeptide. In a further embodiment the immunoglobulin variable region polypeptide is derived from a human immunoglobulin.

In another embodiment the binding domain Fv-immunoglobulin fusion protein binding domain polypeptide comprises (a) at least one immunoglobulin light chain variable region polypeptide; (b) at least one immunoglobulin heavy chain variable region polypeptide; and (c) at least one linker peptide that is fused to the polypeptide of (a) and to the polypeptide of (b). In a further embodiment the immunoglobulin light chain variable region and heavy chain variable region polypeptides are derived from human immunoglobulins.

In another embodiment at least one of the immunoglobulin heavy chain CH2 constant region polypeptide and the immunoglobulin heavy chain CH3 constant region polypeptide is derived from a human immunoglobulin heavy chain. In another embodiment the immunoglobulin heavy chain constant region CH2 and CH3 polypeptides are of an isotype selected from human IgG and human IgA. In another embodiment the antigen is selected from the group consisting of CD19, CD20, CD37, CD40 and L6. In certain further embodiments of the above described fusion protein, the linker polypeptide comprises at least one polypeptide having as an amino acid sequence Gly-Gly-Gly-Gly-Ser [SEQ ID NO: 39], and in certain other embodiments the linker polypeptide comprises at least three repeats of a polypeptide having as an amino acid sequence Gly-Gly-Gly-Gly-Ser [SEQ ID NO: 39]. In certain embodiments the immunoglobulin hinge region polypeptide comprises a human IgA hinge region polypeptide. In certain embodiments the binding domain polypeptide comprises a CD154 extracellular domain. In certain embodiments the binding domain polypeptide comprises a CD154 extracellular domain and at least one immunoglobulin variable region polypeptide.

In other embodiments the invention provides an isolated polynucleotide encoding any of the above described binding domain-immunoglobulin fusion proteins, and in related embodiments the invention provides a recombinant expression construct comprising such a polynucleotide, and in certain further embodiments the invention provides a host cell transformed or transfected with such a recombinant expression construct. In another embodiment the invention provides a method of producing a binding domain-immunoglobulin fusion protein, comprising the steps of (a) culturing the host cell as just described, under conditions that permit expression of the binding domain-immunoglobulin fusion protein; and (b) isolating the binding domain-immunoglobulin fusion protein from the host cell culture.

The present invention also provides in certain embodiments a pharmaceutical composition comprising a binding domain-immunoglobulin fusion protein as described above, in combination with a physiologically acceptable carrier. In another embodiment there is provided a method of treating a subject having or suspected of having a malignant condition or a B-cell disorder, comprising administering to a patient a therapeutically effective amount of an above described binding domain-immunoglobulin fusion protein. In certain further embodiments the malignant condition or B-cell disorder is a B-cell lymphoma or a disease characterized by autoantibody production, and in certain other further embodiments the malignant condition or B-cell disorder is rheumatoid arthritis, myasthenia gravis, Grave's disease, type I diabetes mellitus, multiple sclerosis or an autoimmune disease.

These and other aspects of the present invention will become apparent upon reference to the following detailed description and attached drawings. All references disclosed herein are hereby incorporated by reference in their entireties as if each was incorporated individually.

BRIEF DESCRIPTION OF THE DRAWINGS

FIG. 1 shows DNA and deduced amino acid sequences (SEQ ID NO: 2) of 2H7scFv-Ig, a binding domain-immunoglobulin fusion protein capable of specifically binding CD20.

FIG. 4 shows complement fixation (FIG. 4A) and mediation of antibody-dependent cellular cytotoxicity (ADCC, FIG. 4B)) by 2H7scFv-Ig.

FIG. 7 shows DNA and deduced amino acid sequences of 2H7scFv-CD154 L2 (FIGS. 7A-7B, SEQ ID NOS: 21 and 33) and 2H7scFv-CD154 S4 (FIG. 7C-7D, SEQ ID NOS:22 and 34) binding domain-immunoglobulin fusion proteins capable of specifically binding CD20 and CD40.

FIG. 11 depicts schematic representations of the structures of 2H7ScFv-Ig fusion proteins referred to as CytoxB or CytoxB derivatives: CytoxB-MHWTG1C (2H7 ScFv, mutant hinge, wild-type human IgG1 Fc domain), CytoxB-MHMG1C (2H7 ScFv, mutant hinge, mutated human IgG1 Fc domain) and CytoxB-IgAHWTHG1C (2H7 ScFv, human IgA-derived hinge (SEQ ID NO: 41), wild-type human IgG1 Fc domain). Arrows indicate position numbers of amino acid residues believed to contribute to FcR binding and ADCC activity (heavy arrows), and to complement fixation (light arrows). Note absence of interchain disulfide bonds.

FIG. 19 shows ADCC activity of binding domain-immunoglobulin fusion proteins 2H7 ScFv-Ig, HD37 ScFv-Ig and G28-1 (CD37-specific) ScFv-Ig.

FIG. 23 presents a sequence alignment of immunoglobulin hinge, CH2 and CH3 domains of human IgG1 (SEQ ID NO: 428) with the hinge, CH2 and CH3 domains of llama IgG1 (SEQ ID NO: 430), IgG2 (SEQ ID NO: 432), and IgG3 (SEQ ID NO: 434).

FIG. 31 lists immunoglobulin constant region constructs that were used in experiments illustrated in subsequent figures.

FIG. 33A presents the level of natural killing in Reh CD80.1 cells in the absence of any Ig fusion protein. FIG. 33B presents ADCC mediated by CTLA-4 IgG MTH MTCH2WTCH3, and FIG. 33C presents ADCC mediated by CTLA-4 IgG WTH (CCC) WTCH2CH3. Each data point represents the average percent specific killing measured in four sample wells.

DETAILED DESCRIPTION OF THE INVENTION

Figure 2:
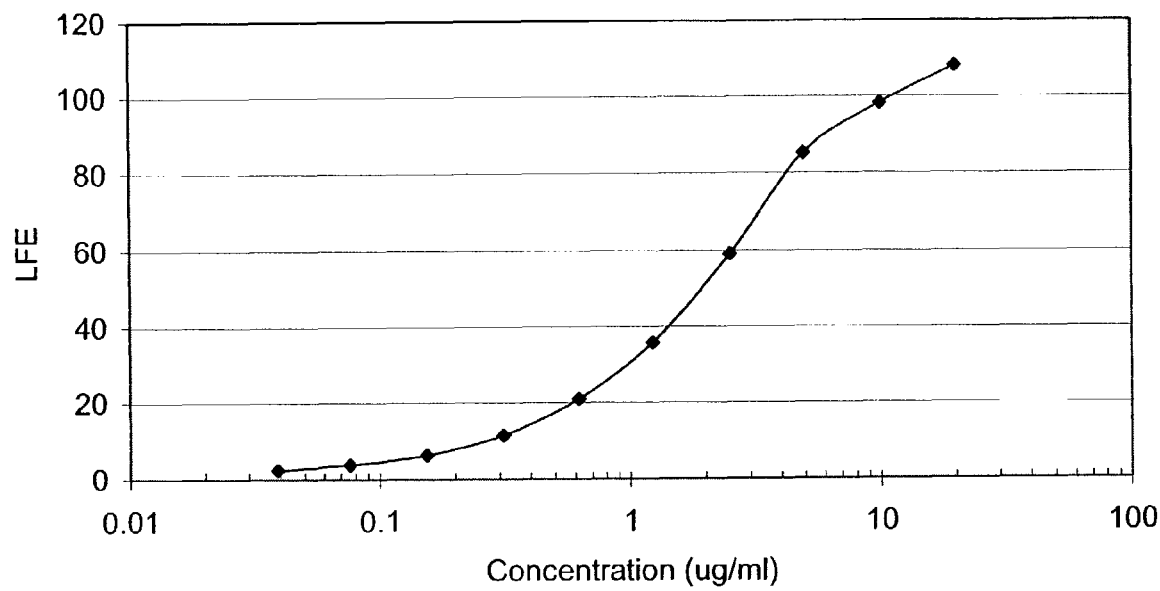
FIG. 2 shows production levels of 2H7 scFv-Ig by transfected, stable CHO lines and generation of a standard curve by binding of purified 2H7 scFv-Ig to CHO cells expressing CD20.

The present invention is directed to binding domain-immunoglobulin fusion proteins and to related compositions and methods, which will be useful in immunotherapeutic and immunodiagnostic applications, and which offer certain advantages over antigen-specific polypeptides of the prior art. The fusion proteins of the present invention are preferably single polypeptide chains that comprise, in pertinent part, the following fused domains: a binding domain polypeptide, an immunoglobulin hinge region polypeptide, an immunoglobulin heavy chain CH2 constant region polypeptide, and an immunoglobulin heavy chain CH3 constant region polypeptide. According to certain preferred embodiments the fusion proteins of the present invention further comprise a plasma membrane anchor domain. According to certain other preferred embodiments the fusion proteins of the present invention further comprise an immunoglobulin heavy chain CH4 constant region polypeptide. In particularly preferred embodiments, the polypeptide domains of which the binding domain-immunoglobulin fusion protein is comprised are, or are derived from, polypeptides that are the products of human gene sequences, but the invention need not be so limited and may in fact relate to binding domain-immunoglobulin fusion proteins as provided herein that are derived from any natural or artificial source, including genetically engineered and/or mutated polypeptides.

The present invention relates in part to the surprising observation that the binding domain-immunoglobulin fusion proteins described herein are capable of immunological activity. More specifically, these proteins retain the ability to participate in well known immunological effector activities including antibody dependent cell mediated cytotoxicity (ADCC, e.g., subsequent to antigen binding on a cell surface, engagement and induction of cytotoxic effector cells bearing appropriate Fc receptors, such as natural killer (NK) cells bearing FcRγIII, under appropriate conditions;) and/or complement fixation in complement dependent cytotoxicity (CDC, e.g., subsequent to antigen binding on a cell surface, recruitment and activation of cytolytic proteins that are components of the blood complement cascade; for reviews of ADCC and CDC see, e.g., Carter, 2001 *Nat. Rev. Canc.* 1:118; Sulica et al., 2001 *Int. Rev. Immunol.* 20:371; Maloney et al., 2002 *Semin. Oncol.* 29:2; Sondel et al., 2001; Maloney 2001 *Anticanc. Drugs* 12 Suppl. 2:1-4; IgA activation of complement by the alternative pathway is described, for example, in Schneiderman et al., 1990 *J. Immunol.* 145:233), despite having structures that would not be expected to be capable of promoting such effector activities. As described in greater detail below, ADCC and CDC are unexpected functions for fusion proteins comprising immunoglobulin heavy chain regions and having the structures described herein, and in particular for immunoglobulin fusion proteins comprising immunoglobulin hinge region polypeptides that are compromised in their ability to form interchain, homodimeric disulfide bonds.

Another advantage afforded by the present invention is a binding domain-immunoglobulin fusion polypeptide that can be produced in substantial quantities that are typically greater than those routinely attained with single-chain antibody constructs of the prior art. In preferred embodiments, the binding domain-immunoglobulin fusion polypeptides of the present invention are recombinantly expressed in mammalian expression systems, which offer the advantage of providing polypeptides that are stable in vivo (e.g., under physiological conditions). According to non-limiting theory, such stability may derive in part from posttranslational modifications, and specifically glycosylation, of the fusion proteins. Production of the present binding domain-immunoglobulin fusion proteins via recombinant mammalian expression has been attained in static cell cultures at a level of greater than 50 mg protein per liter culture supernatant and has been routinely observed in such cultures at 10-50 mg/l, such that preferably at least 10-50 mg/l may be produced under static culture conditions; also contemplated are enhanced production of the fusion proteins using art-accepted scale-up methodologies such as "fed batch" (i.e., non-static) production, where yields of at least 5-500 mg/l, and in some instances at least 0.5-1 gm/l, depending on the particular protein product, are obtained.

A binding domain polypeptide according to the present invention may be any polypeptide that possesses the ability to specifically recognize and bind to a cognate biological molecule or complex of more than one molecule or assembly or aggregate, whether stable or transient, of such a molecule, which includes a protein, polypeptide, peptide, amino acid, or derivative thereof; a lipid, fatty acid or the like, or derivative thereof; a carbohydrate, saccharide or the like or derivative thereof, a nucleic acid, nucleotide, nucleoside, purine, pyrimidine or related molecule, or derivative thereof, or the like; or any combination thereof such as, for example, a glycoprotein, a glycopeptide, a glycolipid, a lipoprotein, a proteolipid; or any other biological molecule that may be present in a biological sample. Biological samples may be provided by obtaining a blood sample, biopsy specimen, tissue explant, organ culture, biological fluid or any other tissue or cell preparation from a subject or a biological source. The subject or biological source may be a human or non-human animal, a primary cell culture or culture adapted cell line including but not limited to genetically engineered cell lines that may contain chromosomally integrated or episomal recombinant nucleic acid sequences, immortalized or immortalizable cell lines, somatic cell hybrid cell lines, differentiated or differentiatable cell lines, transformed cell lines and the like. In certain preferred embodiments of the invention, the subject or biological source may be suspected of having or being at risk for having a malignant condition or a B-cell disorder as provided herein, which in certain further preferred embodiments may be an autoimmune disease, and in certain other preferred embodiments of the invention the subject or biological source may be known to be free of a risk or presence of such disease.

A binding domain polypeptide may therefore be any naturally occurring or recombinantly produced binding partner for a cognate biological molecule as provided herein that is a target structure of interest, herein referred to as an "antigen" but intended according to the present disclosure to encompass any target biological molecule to which it is desirable to have the subject invention fusion protein specifically bind. Binding domain-immunoglobulin fusion proteins are defined to be "immunospecific" or capable of specifically binding if they bind a desired target molecule such as an antigen as provided herein, with a $K_a$ of greater than or equal to about $10^4$ $M^{-1}$, preferably of greater than or equal to about $10^5$ $M^{-1}$, more preferably of greater than or equal to about $10^6$ $M^{-1}$ and still more preferably of greater than or equal to about $10^7$ $M^{-1}$. Affinities of binding domain-immunoglobulin fusion proteins according to the present invention can be readily determined using conventional techniques, for example those described by Scatchard et al., *Ann. N.Y. Acad. Sci.* 51:660 (1949). Such determination of fusion protein binding to target antigens of interest can also be performed using any of a number of known methods for identifying and obtaining proteins that specifically interact with other proteins or polypeptides, for example, a yeast two-hybrid screening system such as that described in U.S. Pat. No. 5,283,173 and U.S. Pat. No. 5,468,614, or the equivalent.

Preferred embodiments of the subject invention binding domain-immunoglobulin fusion protein comprise binding domains that include at least one immunoglobulin variable region polypeptide, such as all or a portion or fragment of a heavy chain or a light chain V-region, provided it is capable of specifically binding an antigen or other desired target structure of interest as described herein. In other preferred embodiments the binding domain comprises a single chain immunoglobulin-derived Fv product, which may include all or a portion of at least one immunoglobulin light chain V-region and all or a portion of at least one immunoglobulin heavy chain V-region, and which further comprises a linker fused to the V-regions; preparation and testing such constructs are described in greater detail herein and are well known in the art. As described herein and as also known in the art, immunoglobulins comprise products of a gene family the members of which exhibit a high degree of sequence conservation, such that amino acid sequences of two or more immunoglobulins or immunoglobulin domains or regions or portions thereof (e.g., VH domains, VL domains, hinge regions, CH2 constant regions, CH3 constant regions) can be aligned and analyzed to identify portions of such sequences that correspond to one another, for instance, by exhibiting pronounced sequence homology. Determination of sequence homology may be readily determined with any of a number of sequence alignment and analysis tools, including computer algorithms well known to those of ordinary skill in the art, such as Align or the BLAST algorithm (Altschul, J. Mol. Biol. 219:555-565, 1991; Henikoff and Henikoff, Proc. Natl. Acad. Sci. USA 89:10915-10919, 1992), which is available at the National Center for Biotechnology Information (NCBI) website. Default parameters may be used.

Portions of a particular immunoglobulin reference sequence and of any one or more additional immunoglobulin sequences of interest that may be compared to the reference sequence are regarded as "corresponding" sequences, regions, fragments or the like, based on the convention for numbering immunoglobulin amino acid positions according to Kabat, *Sequences of Proteins of Immunological Interest*, (5th ed. Bethesda, Md.: Public Health Service, National Institutes of Health (1991)). For example, according to this convention, the immunoglobulin family to which an immunoglobulin sequence of interest belongs is determined based on conservation of variable region polypeptide sequence invariant amino acid residues, to identify a particular numbering system for the immunoglobulin family, and the sequence(s) of interest can then be aligned to assign sequence position numbers to the individual amino acids which comprise such sequence(s). Preferably at least 70%, more preferably at least 80%-85% or 86%-89%, and still more preferably at least 90%, 92%, 94%, 96%, 98% or 99% of the amino acids in a given amino acid sequence of at least 1000, more preferably 700-950, more preferably 350-700, still more preferably 100-350, still more preferably 80-100, 70-80, 60-70, 50-60, 40-50 or 30-40 consecutive amino acids of a sequence, are identical to the amino acids located at corresponding positions in a reference sequence such as those disclosed by Kabat (1991) or in a similar compendium of related immunoglobulin sequences, such as may be generated from public databases (e.g., Genbank, SwissProt, etc.) using sequence alignment tools as described above. In certain preferred embodiments, an immunoglobulin sequence of interest or a region, portion, derivative or fragment thereof is greater than 95% identical to a corresponding reference sequence, and in certain preferred embodiments such a sequence of interest may differ from a corresponding reference at no more than 1, 2, 3, 4, 5, 6, 7, 8, 9 or 10 amino acid positions.

For example, in certain embodiments the present invention is directed to a binding domain-immunoglobulin fusion protein comprising in pertinent part a human immunoglobulin heavy chain variable region polypeptide comprising a mutation at an amino acid at a location corresponding to amino acid position 11 in the VH domain, or amino acid position 155 in SEQ ID NO: 11, position 158 in SEQ ID NO: 12, position 154 in SEQ ID NO:13, or position 159 in SEQ ID NO 14, or amino acid position 11 in the VH domain polypeptides listed in SEQ ID NOS: 341, 354, 465, 471, 477, 548 which comprises a murine VH-derived sequence, and regarding which it is noteworthy that at a relatively limited number of immunoglobulin VH sequence positions, including position 11, amino acid conservation is observed in the overwhelming majority of VH sequences analyzed across mammalian species lines (e.g., Leu11, Val37, Gly44, Leu45, Trp47; Nguyen et al., 1998 *J. Mol. Biol.* 275:413). These amino acid side chains are located at the surface of the variable domain ($V_H$), where they may contact residues of the $C_H1$ (Leu11) and the $V_L$ domains (Va137, Gly44, Leu45, and Trp47) and may, in the absence of light chains, contribute to stability and solubility of the protein (see, e.g., Chothia et al., 1985 *J. Mol. Biol.* 186:651; Muyldermans et al., 1994 *Prot. Engineer.* 7:1129; Desmyter et al., 1996 *Nat. Struct. Biol.* 3:803; Davies et al., 1994 *FEBS Lett.* 339:285). As another example, by reference to immunoglobulin sequence compendia and databases such as those cited above, the relatedness of two or more immunoglobulin sequences to each other can readily and without undue experimentation be established in a manner that permits identification of the animal species of origin, the class and subclass (e.g., isotype) of a particular immunoglobulin or immunoglobulin region polypeptide sequence. Any immunoglobulin variable region polypeptide sequence, including VH and/or VL and/or single-chain variable region (sFv) sequences or other V region-derived sequences or the like, may be used as a binding domain. Preferred embodiments include immunoglobulin V region polypeptide sequences derived from monoclonal antibodies such as murine or other rodent antibodies, or monoclonal antibodies derived from other sources such as goat, rabbit, equine, bovine, camelid or other species, including transgenic animals, and also including human or humanized monoclonal antibodies. Non-limiting examples include variable region polypeptide sequences derived from mAb such as those described in greater detail in the Examples below, for instance, CD20-specific murine monoclonal antibodies (e.g., 2H7), mAb L6 (specific for a carbohydrate-defined epitope and available from American Type Culture Collection, Manassas, Va., as hybridoma HB8677), and mAb specific for CD28 (e.g., mAb 2E12), CD40, CD80, CD137 (e.g., mAb 5B9 or mAb 1D8 which recognizes the human homologue of CD137, 41BB) and CD152 (CTLA-4).

Other binding domain polypeptides may comprise any protein or portion thereof that retains the ability to specifically bind an antigen as provided herein, including non-immunoglobulins. Accordingly the invention contemplates fusion proteins comprising binding domain polypeptides that are derived from polypeptide ligands such as hormones, cytokines, chemokines, and the like; cell surface or soluble receptors for such polypeptide ligands; lectins; intercellular adhesion receptors such as specific leukocyte integrins, selectins, immunoglobulin gene superfamily members, intercellular adhesion molecules (ICAM-1, -2, -3) and the like; histocompatibility antigens; etc.

Examples of cell surface receptors that may provide a binding domain polypeptide, and that may also be selected as the target molecule or antigen to which a binding domain-Ig fusion protein of the present invention desirably binds, include the following, or the like: HER1 (e.g., GenBank Accession Nos. U48722, SEG_HEGFREXS, KO3193), HER2 (Yoshino et al., 1994 *J. Immunol.* 152:2393; Disis et al., 1994 *Canc. Res.* 54:16; see also, e.g., GenBank Acc. Nos. X03363, M17730, SEG_HUMHER20), HER3 (e.g., GenBank Acc. Nos. U29339, M34309), HER4 (Plowman et al., 1993 *Nature* 366:473; see also e.g., GenBank Acc. Nos. L07868, T64105), epidermal growth factor receptor (EGFR) (e.g., GenBank Acc. Nos. U48722, SEG_HEGFREXS, KO3193), vascular endothelial cell growth factor (e.g., GenBank No. M32977), vascular endothelial cell growth factor receptor (e.g., GenBank Acc. Nos. AF022375, 1680143, U48801, X62568), insulin-like growth factor-I (e.g., GenBank Acc. Nos. X00173, X56774, X56773, X06043, see also European Patent No. GB 2241703), insulin-like growth factor-II (e.g., GenBank Acc. Nos. X03562, X00910, SEG_HUMGFIA, SEG_HUMGFI2, M17863, M17862), transferrin receptor (Trowbridge and Omary, 1981 *Proc. Nat. Acad. USA* 78:3039; see also e.g., GenBank Acc. Nos. X01060, M11507), estrogen receptor (e.g., GenBank Acc. Nos. M38651, X03635, X99101, U47678, M12674), progesterone receptor (e.g., GenBank Acc. Nos. X51730, X69068, M15716), follicle stimulating hormone receptor (FSH-R) (e.g., GenBank Acc. Nos. Z34260, M65085), retinoic acid receptor (e.g., GenBank Acc. Nos. L12060, M60909, X77664, X57280, X07282, X06538), MUC-1 (Barnes et al., 1989 *Proc. Nat. Acad. Sci. USA* 86:7159; see also e.g., GenBank Acc. Nos. SEG_MUSMUCIO, M65132, M64928) NY-ESO-1 (e.g., GenBank Acc. Nos. AJ003149, U87459), NA 17-A (e.g., European Patent No. WO 96/40039), Melan-A/MART-1 (Kawakami et al., 1994 *Proc. Nat. Acad. Sci. USA* 91:3515; see also e.g., GenBank Acc. Nos. U06654, U06452), tyrosinase (Topalian et al., 1994 *Proc. Nat. Acad. Sci. USA* 91:9461; see also e.g., GenBank Acc. Nos. M26729, SEG_HUMTYRO, see also Weber et al., *J. Clin. Invest* (1998) 102:1258), Gp-100 (Kawakami et al., 1994 *Proc. Nat. Acad. Sci. USA* 91:3515; see also e.g., GenBank Acc. No. 573003, see also European Patent No. EP 668350; Adema et al., 1994 *J. Biol. Chem.* 269:20126), MAGE (van den Bruggen et al., 1991 *Science* 254:1643; see also e.g, GenBank Acc. Nos. U93163, AF064589, U66083, D32077, D32076, D32075, U10694, U10693, U10691, U10690, U10689, U10688, U10687, U10686, U10685, L18877, U10340, U10339, L18920, U03735, M77481), BAGE (e.g., GenBank Acc. No. U19180, see also U.S. Pat. Nos. 5,683,886 and 5,571,711), GAGE (e.g., GenBank Acc. Nos. AF055475, AF055474, AF055473, U19147, U19146, U19145, U19144, U19143, U19142), any of the CTA class of receptors including in particular HOM-MEL-40 antigen encoded by the SSX2 gene (e.g., GenBank Acc. Nos. X86175, U90842, U90841, X86174), carcinoembyonic antigen (CEA, Gold and Freedman, 1985 *J. Exp. Med.* 121:439; see also e.g., GenBank Acc. Nos. SEG_HUMCEA, M59710, M59255, M29540), and PyLT (e.g., GenBank Acc. Nos. J02289, J02038).

Additional cell surface receptors that may be sources of binding domain polypeptides or that may be cognate antigens include the following, or the like: CD2 (e.g., GenBank Acc. Nos. Y00023, SEG_HUMCD2, M16336, M16445, SEG_MUSCD2, M14362), 4-1BB (CDw137, Kwon et al., 1989 *Proc. Nat. Acad. Sci. USA* 86:1963, 4-1BB ligand (Goodwin et al., 1993 *Eur. J. Immunol.* 23:2361; Melero et al., 1998 *Eur. J. Immunol.* 3:116), CD5 (e.g., GenBank Acc. Nos. X78985, X89405), CD10 (e.g., GenBank Acc. Nos. M81591, X76732) CD27 (e.g., GenBank Acc. Nos. M63928, L24495, L08096), CD28 (June et al., 1990 *Immunol. Today* 11:211; see also, e.g., GenBank Acc. Nos. J02988, SEG_HUMCD28, M34563), CD152/CTLA-4 (e.g., GenBank Acc. Nos. L15006, X05719, SEG_HUMIGCTL), CD40 (e.g., GenBank Acc. Nos. M83312, SEG_MUSC040A0, Y10507, X67878, X96710, U15637, L07414), interferon-γ (IFN-γ; see, e.g., Farrar et al. 1993 *Ann. Rev. Immunol.* 11:571 and references cited therein), Gray et al. 1982 *Nature* 295:503, Rinderknecht et al. 1984 *J. Biol. Chem.* 259:6790, DeGrado et al. 1982 *Nature* 300:379), interleukin-4 (IL-4; see, e.g., 53$^{rd}$ *Forum in Immunology,* 1993 *Research in Immunol.* 144: 553-643; Banchereau et al., 1994 in *The Cytokine Handbook,* 2$^{nd}$ ed., A. Thomson, ed., Academic Press, NY, p. 99; Keegan et al., 1994 *J Leukocyt. Biol.* 55:272, and references cited therein), interleukin-17 (IL-17) (e.g., GenBank Acc. Nos. U32659, U43088) and interleukin-17 receptor (IL-17R) (e.g., GenBank Acc. Nos. U31993, U58917). Notwithstanding the foregoing, the present invention expressly does not encompass any immunoglobulin fusion protein that is disclosed in U.S. Pat. No. 5,807,734, U.S. Pat. No. 5,795,572 or U.S. Pat. No. 5,807,734.

Additional cell surface receptors that may be sources of binding domain polypeptides or that may be cognate antigens include the following, or the like: CD59 (e.g., GenBank Acc. Nos. SEG_HUMCD590, M95708, M34671), CD48 (e.g., GenBank Acc. Nos. M59904), CD58/LFA-3 (e.g., GenBank Acc. No. A25933, Y00636, E12817; see also JP 1997075090-A), CD72 (e.g., GenBank Acc. Nos. AA311036, S40777, L35772), CD70 (e.g., GenBank Acc. Nos. Y13636, S69339), CD80/B7.1 (Freeman et al., 1989 *J. Immunol.* 43:2714; Freeman et al., 1991 *J. Exp. Med.* 174:625; see also e.g., GenBank Acc. Nos. U33208, I683379), CD86/B7.2 (Freeman et al., 1993 *J. Exp. Med.* 178:2185, Boriello et al., 1995 *J. Immunol.* 155:5490; see also, e.g., GenBank Acc. Nos. AF099105, SEG_MMB72G, U39466, U04343, SEG_HSB725, L25606, L25259), B7-H1/B7-DC (e.g., Genbank Acc. Nos. NM_014143, AF177937, AF317088; Dong et al., 2002 *Nat. Med.* June 24 [epub ahead of print], PMID 12091876; Tseng et al., 2001 *J. Exp. Med.* 193:839; Tamura et al., 2001 *Blood* 97:1809; Dong et al., 1999 *Nat. Med.* 5:1365), CD40 ligand (e.g., GenBank Acc. Nos. SEG_HUMCD40L, X67878, X65453, L07414), IL-17 (e.g., GenBank Acc. Nos. U32659, U43088), CD43 (e.g., GenBank Acc. Nos. X52075, J04536), ICOS (e.g., Genbank Acc. No. AH011568), CD3 (e.g., Genbank Acc. Nos. NM_000073 (gamma subunit), NM_000733 (epsilon subunit), X73617 (delta subunit)), CD4 (e.g., Genbank Acc. No. NM_000616), CD25 (e.g., Genbank Acc. No. NM_000417), CD8 (e.g., Genbank Acc. No. M12828), CD11b (e.g., Genbank Acc. No. J03925), CD14 (e.g., Genbank Acc. No. XM_039364), CD56 (e.g., Genbank Acc. No. U63041), CD69 (e.g., Genbank Acc. No. NM_001781) and VLA-4 ($\alpha_4\beta_7$) (e.g., GenBank Acc. Nos. L12002, X16983, L20788, U97031, L24913, M68892, M95632). The following cell surface receptors are typically associated with B cells: CD19 (e.g., GenBank Acc. Nos. SEG_HUMCD19W0, M84371, SEG_MUSCD19W, M62542), CD20 (e.g., GenBank Acc. Nos. SEG_HUMCD20, M62541), CD22 (e.g., GenBank Acc. Nos. 1680629, Y10210, X59350, U62631, X52782, L16928), CD30 (e.g., Genbank Acc. Nos. M83554, D86042), CD153 (CD30 ligand, e.g., GenBank Acc. Nos. L09753, M83554), CD37 (e.g., GenBank Acc. Nos. SEG_MMCD37X, X14046, X53517), CD50 (ICAM-3, e.g., GenBank Acc. No. NM_002162), CD106 (VCAM-1) (e.g., GenBank Acc. Nos. X53051, X67783, SEG_MMVCAM1C, see also U.S. Pat. No. 5,596,090), CD54 (ICAM-1) (e.g., GenBank Acc. Nos. X84737, S82847, X06990, J03132, SEG_MUSICAM0), interleukin-12 (see, e.g., Reiter et al, 1993 *Crit. Rev. Immunol.* 13:1, and references cited therein), CD134 (OX40, e.g., GenBank Acc. No. AJ277151), CD137 (41BB, e.g., GenBank Acc. No. L12964, NM_001561), CD83 (e.g., GenBank Acc. Nos. AF001036, AL021918), DEC-205 (e.g., GenBank Acc. Nos. AF011333, U19271).

Binding domain-immunoglobulin fusion proteins of the present invention comprise a binding domain polypeptide that, according to certain particularly preferred embodiments, is capable of specifically binding at least one antigen that is present on an immune effector cell. According to non-limiting theory, such binding domain-Ig fusion proteins may advantageously recruit desired immune effector cell function(s) in a therapeutic context, where it is well known that immune effector cells having different specialized immune functions can be distinguished from one another on the basis of their differential expression of a wide variety of cell surface antigens, such as many of the antigens described herein to which binding domain polypeptides can specifically bind. Immune effector cells include any cell that is capable of directly mediating an activity which is a component of immune system function, including cells having such capability naturally or as a result of genetic engineering.

In certain embodiments an immune effector cell comprises a cell surface receptor for an immunoglobulin, such as a receptor for an immunoglobulin constant region and including the class of receptors commonly referred to as "Fc receptors" (FcR). A number of FcR have been structurally and/or functionally characterized and are well known in the art, including FcR having specific abilities to interact with a restricted subset of immunoglobulin heavy chain isotypes, or that interact with Fc domains with varying affinities, and/or which may be expressed on restricted subsets of immune effector cells under certain conditions (e.g., Kijimoto-Ochichai et al., 2002 *Cell Mol. Life. Sci.* 59:648; Davis et al., 2002 *Curr. Top. Microbiol. Immunol.* 266:85; Pawankar, 2001 *Curr. Opin. Allerg. Clin. Immunol.* 1:3; Radaev et al., 2002 *Mol. Immunol.* 38:1073; Wurzburg et al., 2002 *Mol. Immunol.* 38:1063; Sulica et al., 2001 *Int. Rev. Immunol.* 20:371; Underhill et al., 2002 *Ann. Rev. Immunol.* 20:825; Coggeshall, 2002 *Curr. Dir. Autoimm.* 5:1; Mimura et al., 2001 *Adv. Exp. Med. Biol.* 495:49; Baumann et al., 2001 *Adv.*

*Exp. Med. Biol.* 495:219; Santoso et al., 2001 *Ital. Heart J.* 2:811; Novak et al., 2001 *Curr. Opin. Immunol.* 13:721; Fossati et al., 2001 *Eur. J. Clin. Invest.* 31:821).

Cells that are capable of mediating ADCC are preferred examples of immune effector cells according to the present invention. Other preferred examples include natural killer (NK) cells, tumor-infiltrating T lymphocytes (TIL), cytotoxic T lymphocytes (CTL), and granulocytic cells such as cells that comprise allergic response mechanisms. Immune effector cells thus include, but are not limited to, cells of hematopoietic origins including cells at various stages of differentiation within myeloid and lymphoid lineages and which may (but need not) express one or more types of functional cell surface FcR, such as T lymphocytes, B lymphocytes, NK cells, monocytes, macrophages, dendritic cells, neutrophils, basophils, eosinophils, mast cells, platelets, erythrocytes, and precursors, progenitors (e.g., hematopoietic stem cells), quiescent, activated and mature forms of such cells. Other immune effector cells may include cells of non-hematopoietic origin that are capable of mediating immune functions, for example, endothelial cells, keratinocytes, fibroblasts, osteoclasts, epithelial cells and other cells. Immune effector cells may also include cells that mediate cytotoxic or cytostatic events, or endocytic, phagocytic, or pinocytotic events, or that effect induction of apoptosis, or that effect microbial immunity or neutralization of microbial infection, or cells that mediate allergic, inflammatory, hypersensitivity and/or autoimmune reactions.

Allergic response mechanisms are well known in the art and include an antigen (e.g., allergen)-specific component such as an immunoglobulin (e.g., IgE), as well as the cells and mediators which comprise sequelae to allergen-immunoglobulin (e.g., IgE) encounters (e.g., Ott et al., 2000 *J. Allerg. Clin. Immunol.* 106:429; Barnes, 2000 *J. Allerg. Clin. Immunol.* 106:5; Togias, 2000 *J. Allerg. Clin. Immunol.* 105:S599; Akdis et al., 2000 *Int. Arch. Allerg. Immunol.* 121:261; Beach, 2000 *Occup. Med.* 15:455). Particularly with regard to binding domain-immunoglobulin fusion proteins of the present invention that interact with FcR, certain embodiments of the present invention contemplate fusion proteins that comprise one or more IgE-derived domains and that are capable of inducing an allergic response mechanism that comprises IgE-specific FcR, as also noted above and as described in the cited references. Without wishing to be bound by theory, and as disclosed herein, fusion proteins of the present invention may comprise portions of IgE heavy chain Fc domain polypeptides, whether expressed as cell surface proteins (e.g., with a plasma membrane anchor domain) or as soluble proteins (e.g., without a plasma membrane anchor domain). Further according to non-limiting theory, recruitment and induction of an allergic response mechanism (e.g., an FcR-epsilon expressing immune effector cell) may proceed as the result of either or both of the presence of an IgE Fc domain (e.g., that is capable of triggering an allergic mechanism by FcR crosslinking) and the presence of the cognate antigen to which the binding domain specifically binds. The present invention therefore exploits induction of allergic response mechanisms in heretofore unappreciated contexts, such as treatment of a malignant condition or a B-cell disorder as described herein.

An immunoglobulin hinge region polypeptide, as discussed above, includes any hinge peptide or polypeptide that occurs naturally, as an artificial peptide or as the result of genetic engineering and that is situated in an immunoglobulin heavy chain polypeptide between the amino acid residues responsible for forming intrachain immunoglobulin-domain disulfide bonds in CH1 and CH2 regions; hinge region polypeptides for use in the present invention may also include a mutated hinge region polypeptide. Accordingly, an immunoglobulin hinge region polypeptide may be derived from, or may be a portion or fragment of (i.e., one or more amino acids in peptide linkage, typically 15-115 amino acids, preferably 95-110, 80-94, 60-80, or 5-65 amino acids, preferably 10-50, more preferably 15-35, still more preferably 18-32, still more preferably 20-30, still more preferably 21, 22, 23, 24, 25, 26, 27, 28 or 29 amino acids) an immunoglobulin polypeptide chain region classically regarded as having hinge function, as described above, but a hinge region polypeptide for use in the instant invention need not be so restricted and may include amino acids situated (according to structural criteria for assigning a particular residue to a particular domain that may vary, as known in the art) in an adjoining immunoglobulin domain such as a CH1 domain or a CH2 domain, or in the case of certain artificially engineered immunoglobulin constructs, an immunoglobulin variable region domain.

Wild-type immunoglobulin hinge region polypeptides include any naturally occurring hinge region that is located between the constant region domains, CH1 and CH2, of an immunoglobulin. The wild-type immunoglobulin hinge region polypeptide is preferably a human immunoglobulin hinge region polypeptide, preferably comprising a hinge region from a human IgG, IgA or IgE immunoglobulin, and more preferably, a hinge region polypeptide from a wild-type or mutated human IgG1 isotype as described herein. As is known to the art, despite the tremendous overall diversity in immunoglobulin amino acid sequences, immunoglobulin primary structure exhibits a high degree of sequence conservation in particular portions of immunoglobulin polypeptide chains, notably with regard to the occurrence of cysteine residues which, by virtue of their sulfyhydryl groups, offer the potential for disulfide bond formation with other available sulfydryl groups. Accordingly, in the context of the present invention wild-type immunoglobulin hinge region polypeptides may be regarded as those that feature one or more highly conserved (e.g., prevalent in a population in a statistically significant manner) cysteine residues, and in certain preferred embodiments a mutated hinge region polypeptide may be selected that contains zero or one cysteine residue and that is derived from such a wild-type hinge region.

In certain preferred embodiments wherein the hinge region polypeptide is a mutated human IgG1 immunoglobulin hinge region polypeptide that is derived from a wild-type hinge region, it is noted that the wild-type human IgG1 hinge region polypeptide sequence comprises three non-adjacent cysteine residues, referred to as a first cysteine of the wild-type hinge region, a second cysteine of the wild-type hinge region and a third cysteine of the wild-type hinge region, respectively, proceeding along the hinge region sequence from the polypeptide N-terminus toward the C-terminus. Accordingly, in certain such embodiments of the present invention, the mutated human IgG1 immunoglobulin hinge region polypeptide contains two cysteine residues and the first cysteine of the wild-type hinge region is not mutated. In certain other embodiments of the present invention the mutated human IgG1 immunoglobulin hinge region polypeptide contains no more than one cysteine residue, and in certain other embodiments the mutated human IgG1 immunoglobulin hinge region polypeptide contains no cysteine residues.

The binding domain-immunoglobulin fusion proteins of the present invention expressly do not contemplate any fusion protein that is disclosed in U.S. Pat. No. 5,892,019. For example, and as disclosed in U.S. Pat. No. 5,892,019, a mutated human IgG1 hinge region described therein has a substitution or deletion of the first IgG1 hinge region cysteine residue, but retains both of the second and third IgG1 hinge region cysteine residues that correspond to the second and third cysteines of the wild-type IgG1 hinge region sequence. This reference discloses that the first cysteine residue of the wild-type IgG1 hinge region is replaced to prevent interference, by the first cysteine residue, with proper assembly of the single chain immunoglobulin-like polypeptide described therein into an immunoglobulin-like dimer. As also disclosed in this reference, the second and third cysteines of the IgG1 hinge region are retained to provide interchain disulfide linkage between two heavy chain constant regions to promote dimer formation, which further according to U.S. Pat. No. 5,892,019 results in an immunoglobulin-like dimer having effector function such as ADCC capability.

By contrast and as described herein, the binding domain-immunoglobulin fusion proteins of the present invention, which are capable of ADCC, are not so limited and may comprise, in pertinent part, (i) a wild-type human IgG1 immunoglobulin hinge region polypeptide, (ii) a mutated human IgG1 immunoglobulin hinge region polypeptide that is derived from a wild-type immunoglobulin hinge region polypeptide having three or more cysteine residues, wherein the mutated human IgG1 immunoglobulin hinge region polypeptide contains two cysteine residues and wherein a first cysteine of the wild-type hinge region is not mutated, (iii) a mutated human IgG1 immunoglobulin hinge region polypeptide that is derived from a wild-type immunoglobulin hinge region polypeptide having three or more cysteine residues, wherein the mutated human IgG1 immunoglobulin hinge region polypeptide contains no more than one cysteine residue, or (iv) a mutated human IgG1 immunoglobulin hinge region polypeptide that is derived from a wild-type immunoglobulin hinge region polypeptide having three or more cysteine residues, wherein the mutated human IgG1 immunoglobulin hinge region polypeptide contains no cysteine residues. In particular, the present invention thus offers unexpected advantages associated with retention by the fusion proteins described herein of the ability to mediate ADCC even where the ability to dimerize via IgG1 hinge region interchain disulfide bonds is ablated or compromised by the removal or replacement of one, two or three hinge region cysteine residues, and even where the first cysteine of the IgG1 hinge region is not mutated.

A mutated immunoglobulin hinge region polypeptide may comprise a hinge region that has its origin in an immunoglobulin of a species, of an immunoglobulin isotype or class, or of an immunoglobulin subclass that is different from that of the CH2 and CH3 domains. For instance, in certain embodiments of the invention, the binding domain-immunoglobulin fusion protein may comprise a binding domain polypeptide that is fused to an immunoglobulin hinge region polypeptide comprising a wild-type human IgA hinge region polypeptide, or a mutated human IgA hinge region polypeptide that contains zero or only one cysteine residues, as described herein, or a wild-type human IgG1 hinge region polypeptide or a wild-type human IgE hinge region polypeptide or a mutated human IgG1 hinge region polypeptide that is mutated to contain zero, one or two cysteine residues wherein the first cysteine of the wild-type hinge region is not mutated, as also described herein. Such a hinge region polypeptide may be fused to an immunoglobulin heavy chain CH2 region polypeptide from a different Ig isotype or class, for example an IgA or an IgE or an IgG subclass, which in certain preferred embodiments will be the IgG1 subclass and in certain other preferred embodiments may be any one of the IgG2, IgG3 or IgG4 subclasses.

For example, and as described in greater detail below, in certain embodiments of the present invention an immunoglobulin hinge region polypeptide is selected which is derived from a wild-type human IgA hinge region that naturally comprises three cysteines, where the selected hinge region polypeptide is truncated relative to the complete hinge region such that only one of the cysteine residues remains (e.g., SEQ ID NOS:35-36). Similarly, in certain other embodiments of the invention, the binding domain-immunoglobulin fusion protein comprises a binding domain polypeptide that is fused to an immunoglobulin hinge region polypeptide comprising a mutated hinge region polypeptide in which the number of cysteine residues is reduced by amino acid substitution or deletion, for example a mutated IgG1 hinge region containing zero, one or two cysteine residues as described herein. A mutated hinge region polypeptide may thus be derived from a wild-type immunoglobulin hinge region that contains one or more cysteine residues. In certain embodiments, a mutated hinge region polypeptide may contain zero or only one cysteine residue, wherein the mutated hinge region polypeptide is derived from a wild type immunoglobulin hinge region that contains, respectively, one or more or two or more cysteine residues. In the mutated hinge region polypeptide, the cysteine residues of the wild-type immunoglobulin hinge region are preferably substituted with amino acids that are incapable of forming a disulfide bond. In one embodiment of the invention, the mutated hinge region polypeptide is derived from a human IgG wild-type hinge region polypeptide, which may include any of the four human IgG isotype subclasses, IgG1, IgG2, IgG3 or IgG4. In certain preferred embodiments, the mutated hinge region polypeptide is derived from a human IgG1 wild-type hinge region polypeptide. By way of example, a mutated hinge region polypeptide derived from a human IgG1 wild-type hinge region polypeptide may comprise mutations at two of the three cysteine residues in the wild-type immunoglobulin hinge region, or mutations at all three cysteine residues.

The cysteine residues that are present in a wild-type immunoglobulin hinge region and that are removed by mutagenesis according to particularly preferred embodiments of the present invention include cysteine residues that form, or that are capable of forming, interchain disulfide bonds. Without wishing to be bound by theory, the present invention contemplates that mutation of such hinge region cysteine residues, which are believed to be involved in formation of interchain disulfide bridges, reduces the ability of the subject invention binding domain-immunoglobulin fusion protein to dimerize (or form higher oligomers) via interchain disulfide bond formation, while surprisingly not ablating the ability of the fusion protein to promote antibody dependent cell-mediated cytotoxicity (ADCC) or to fix complement. In particular, the Fc receptors (FcR) which mediate ADCC (e.g., FcRIII, CD16) exhibit low affinity for immunoglobulin Fc domains, suggesting that functional binding of Fc to FcR requires avidity stabilization of the Fc-FcR complex by virtue of the dimeric structure of heavy chains in a conventional antibody, and/or FcR aggregation and cross-linking by a conventional Ab Fc structure. (Sonderman et al., 2000 *Nature* 406:267; Radaev et al., 2001 *J. Biol. Chem.* 276:16469; Radaev et al., 2001 *J. Biol. Chem.* 276:16478; Koolwijk et al., 1989 *J. Immunol.* 143:1656; Kato et al., 2000 *Immunol. Today* 21:310.) Hence, the binding domain-immunoglobulin fusion proteins of the present invention provide the advantages associated with single-chain immunoglobulin fusion proteins while also unexpectedly retaining immunological activity. Similarly, the ability to fix complement is typically associated with immunoglobulins that are dimeric with respect to heavy chain constant regions such as those that comprise Fc, while the binding domain-immunoglobulin fusion proteins of the present invention, which may, due to the replacement or deletion of hinge region cysteine residues or due to other structural modifications as described herein, have compromised or ablated abilities to form interchain disulfide bonds, exhibit the unexpected ability to fix complement. Additionally, according to certain embodiments of the present invention wherein a binding domain-immunoglobulin fusion protein may comprise one or more of a human IgE hinge region polypeptide, a human IgE CH2 constant region polypeptide, a human IgE CH3 constant region polypeptide, and a human IgE CH4 constant region polypeptide, the invention fusion proteins unexpectedly retain the immunological activity of mediating ADCC and/or of inducing an allergic response mechanism.

Selection of an immunoglobulin hinge region polypeptide according to certain embodiments of the subject invention binding domain-immunoglobulin fusion proteins may relate to the use of an "alternative hinge region" polypeptide sequence, which includes a polypeptide sequence that is not necessarily derived from any immunoglobulin hinge region sequence per se. Instead, an alternative hinge region refers to a hinge region polypeptide that comprises an amino acid sequence of at least ten consecutive amino acids, and in certain embodiments at least 11, 12, 13, 14, 15, 16, 17, 18, 19, 20, 21-25, 26-30, 31-50, 51-60, 71-80, 81-90, or 91-110 amino acids that is present in a sequence selected from any one of SEQ ID NOS: 215, 216, 217, 218, 223, 224, 6, 15, 16. 35, 36, 37, 41, 207, 208, 223, 275, 276, 277, 296, 300, 350, 390, 391, 392, 396, 397, 398, 488, 582, 584, 586, for example a polypeptide sequence derived from a region located between intrachain disulfide-generated immunoglobulin-like loop domains of immunoglobulin gene superfamily members such as CD2 (e.g., Genbank Acc. No. NM_001767), CD4 (e.g., Genbank Acc. No. NM_000616), CD5 (e.g., Genbank Acc. No. BC027901), CD6 (e.g., Genbank Acc. No. NM_006725), CD7 (e.g., Genbank Acc. Nos. XM_046782, BC009293, NM_006137) or CD8 (e.g., Genbank Acc. No. M12828), or other Ig superfamily members. By way of non-limiting example, an alternative hinge region may provide a glycosylation site as provided herein, or may provide a human gene-derived polypeptide sequence for purposes of enhancing the degree of "humanization" of a fusion protein, or may comprise an amino acid sequence that reduces the ability of a fusion protein to form multimers or oligomers or aggregates or the like. Certain alternative hinge region polypeptide sequences as described herein may be derived from the polypeptide sequences of immunoglobulin gene super-family members that are not actual immunoglobulins per se. For instance and according to non-limiting theory, certain polypeptide sequences that are situated between intrachain disulfide-generated immunoglobulin loop domain of immunoglobulin gene super-family member proteins may be used as alternative hinge region polypeptides as provided herein, or may be further modified for such use.

As noted above, binding domain-immunoglobulin fusion proteins are believed, according to non-limiting theory, to be compromised in their ability to dimerize via interchain disulfide bond formation, and further according to theory, this property is a consequence of a reduction in the number of cysteine residues that are present in the immunoglobulin hinge region polypeptide selected for inclusion in the construction of the fusion protein. Determination of the relative ability of a polypeptide to dimerize is well within the knowledge of the relevant art, where any of a number of established methodologies may be applied to detect protein dimerization (see, e.g., Scopes, *Protein Purification: Principles and Practice*, 1987 Springer-Verlag, New York). For example, biochemical separation techniques for resolving proteins on the basis of molecular size (e.g., gel electrophoresis, gel filtration chromatography, analytical ultracentrifugation, etc.), and/or comparison of protein physicochemical properties before and after introduction of sulfhydryl-active (e.g., iodoacetamide, N-ethylmaleimide) or disulfide-reducing (e.g., 2-mercaptoethanol, dithiothreitol) agents, or other equivalent methodologies, may all be employed for determining a degree of polypeptide dimerization or oligomerization, and for determining possible contribution of disulfide bonds to such potential quarternary structure. In certain embodiments, the invention relates to a binding domain-immunoglobulin fusion protein that exhibits a reduced (i.e., in a statistically significant manner relative to an appropriate IgG-derived control) ability to dimerize, relative to a wild-type human immunoglobulin G hinge region polypeptide as provided herein. Accordingly, those familiar with the art will be able readily to determine whether a particular fusion protein displays such reduced ability to dimerize.

Compositions and methods for preparation of immunoglobulin fusion proteins are well known in the art, as described for example, in U.S. Pat. No. 5,892,019, which discloses recombinant antibodies that are the products of a single encoding polynucleotide but which are not binding domain-immunoglobulin fusion proteins according to the present invention.

For an immunoglobulin fusion protein of the invention which is intended for use in humans, the constant regions will typically be of human sequence origin, to minimize a potential anti-human immune response and to provide appropriate effector functions. Manipulation of sequences encoding antibody constant regions is described in the PCT publication of Morrison and Oi, WO 89/07142. In particularly preferred embodiments, the CH1 domain is deleted and the carboxyl end of the binding domain, or where the binding domain comprises two immunoglobulin variable region polypeptides, the second (i.e., more proximal to the C-terminus) variable region is joined to the amino terminus of CH2 through the hinge region. A schematic diagram depicting the structures of two exemplary binding domain-immunoglobulin fusion proteins is shown in FIG. 11, where it should be noted that in particularly preferred embodiments no interchain disulfide bonds are present, and in other embodiments a restricted number of interchain disulfide bonds may be present relative to the number of such bonds that would be present if wild-type hinge region polypeptides were instead present, and that in other embodiments the fusion protein comprises a mutated hinge region polypeptide that exhibits a reduced ability to dimerize, relative to a wild-type human IgG hinge region polypeptide. Thus, the isolated polynucleotide molecule codes for a single chain immunoglobulin fusion protein having a binding domain that provides specific binding affinity for a selected antigen.

The invention also contemplates in certain embodiments binding domain-immunoglobulin fusion proteins as provided herein that comprise fused polypeptide sequences or portions thereof derived from a plurality of genetic sources, for example, according to molecular "domain swapping" paradigms. Those having familiarity with the art will readily appreciate that selection of such polypeptide sequences for assembly into a binding domain-immunoglobulin fusion protein may involve determination of what are appropriate portions of each component polypeptide sequence, based on structural and/or functional properties of each such sequence (see, e.g., Carayannopoulos et al., 1996 *J. Exp. Med.* 183:

1579; Harlow et al., Eds., *Antibodies: A Laboratory Manual*, Cold Spring Harbor Laboratory, Cold Spring Harbor (1988)). The component polypeptide sequences of which the fusion protein is comprised may therefore comprise intact or full-length binding domain, immunoglobulin, linker and/or plasma membrane anchor domain polypeptide sequences, or truncated versions or variants thereof as provided herein. According to these and related embodiments of the invention, any two or more of the candidate component polypeptides of which the subject invention fusion protein may be comprised will be derived from independent sources, such as from immunoglobulin sequences of differing allotype, isotype, subclass, class, or species of origin (e.g., xenotype). Thus, as a non-limiting example, a binding domain polypeptide (or its constituent polypeptides such as one or more variable region polypeptides and/or a linker polypeptide), a hinge region polypeptide, immunoglobulin heavy chain CH2 and CH3 constant region polypeptides and optionally an immunoglobulin heavy chain CH4 constant region polypeptide as may be obtained from an IgM or IgE heavy chain, and a plasma membrane anchor domain polypeptide may all be separately obtained from distinct genetic sources and engineered into a chimeric or fusion protein using well known techniques and according to methodologies described herein.

Accordingly, a binding domain-immunoglobulin fusion protein according to certain embodiments of the present invention may also therefore comprise in pertinent part an immunoglobulin heavy chain CH3 constant region polypeptide that is a wild-type IgA CH3 constant region polypeptide, or alternatively, that is a mutated IgA CH3 constant region polypeptide that is incapable of associating with a J chain; preferably the IgA CH3 constant region polypeptides are of human origin. By way of brief background, IgA molecules are known to be released into secretory fluids by a mechanism that involves association of IgA into disulfide-linked polymers (e.g., dimers) via a J chain polypeptide (e.g., Genbank Acc. Nos. XM_059628, M12378, M12759; Johansen et al., 1999 *Eur. J. Immunol.* 29:1701) and interaction of the complex so formed with another protein that acts as a receptor for polymeric immunoglobulin, and which is known as transmembrane secretory component (S C; Johansen et al., 2000 *Sc. J. Immunol.* 52:240; see also, e.g., Sorensen et al., 2000 *Int. Immunol.* 12:19; Yoo et al., 1999 *J. Biol. Chem.* 274:33771; Yoo et al., 2002 *J. Immunol. Meth.* 261:1; Corthesy, 2002 *Trends Biotechnol.* 20:65; Symersky et al., 2000 *Mol. Immunol.* 37:133; Crottet et al., 1999 *Biochem. J.* 341:299). Interchain disulfide bond formation between IgA Fc domains and J chain is mediated through a penultimate cysteine residue in an 18-amino acid C-terminal extension that forms part of the IgA heavy chain constant region CH3 domain polypeptide (Yoo et al., 1999; Sorensen et al., 2000). Certain embodiments of the subject invention fusion proteins therefore contemplate inclusion of the wild-type IgA heavy chain constant region polypeptide sequence, which is capable of associating with J chain. Certain other embodiments of the invention, however, contemplate fusion proteins that comprise a mutated IgA CH3 constant region polypeptide that is incapable of associating with a J chain. According to such embodiments, two or more residues from the C-terminus of an IgA CH3 constant region polypeptide such as a human IgA CH3 constant region polypeptide may be deleted to yield a truncated CH3 constant region polypeptide as provided herein. In preferred embodiments and as described in greater detail below, a mutated human IgA CH3 constant region polypeptide that is incapable of associating with a J chain comprises such a C-terminal deletion of either four or 18 amino acids. However, the invention need not be so limited, such that the mutated IgA CH3 constant region polypeptide may comprise a deletion of 2, 3, 4, 5, 6, 7, 8, 9, 10, 11, 12, 13, 14, 15, 16, 17, 18, 19, 20-21-25, 26-30 or more amino acids, so long as the fusion protein is capable of specifically binding an antigen and of at least one immunological activity as provided herein. Alternatively, the invention also contemplates fusion proteins that comprise a mutated IgA CH3 constant region polypeptide that is incapable of associating with a J chain by virtue of replacement of the penultimate cysteine, or by chemical modification of that amino acid residue, in a manner that prevents interchain disulfide bond formation. Methods for determining whether a fusion protein can associate with a J chain will be known to those having familiarity with the art and are described herein, including in the cited references.

As also described herein and according to procedures known in the art, the fusion protein may further be tested routinely for immunological activity, for instance, in ADCC or CDC assays. As an illustrative example, a fusion protein according to such an embodiment may comprise a binding domain polypeptide derived from a human heavy chain variable region polypeptide sequence, a human IgA-derived immunoglobulin hinge region polypeptide sequence, a human IgG1 immunoglobulin heavy chain CH2 constant region polypeptide sequence, a human IgG2 immunoglobulin heavy chain CH3 constant region polypeptide sequence, and optionally a human IgE immunoglobulin heavy chain CH4 constant region polypeptide sequence and/or a human TNF-α receptor type 1 (TNFR1) plasma membrane anchor domain polypeptide sequence that comprises a cytoplasmic tail polypeptide which is capable of apoptotic signaling. The invention therefore contemplates these and other embodiments according to the present invention in which two or more polypeptide sequences that are present in a fusion protein have independent genetic origins.

As noted above, in certain embodiments the binding protein-immunoglobulin fusion protein comprises at least one immunoglobulin variable region polypeptide, which may be a light chain or a heavy chain variable region polypeptide, and in certain embodiments the fusion protein comprises at least one such light chain V-region and one such heavy chain V-region and at least one linker peptide that is fused to each of the V-regions. Construction of such binding domains, for example single chain Fv domains, is well known in the art and is described in greater detail in the Examples below, and has been described, for example, in U.S. Pat. No. 5,892,019 and references cited therein; selection and assembly of single-chain variable regions and of linker polypeptides that may be fused to each of a heavy chain-derived and a light chain-derived V region (e.g., to generate a binding domain that comprises a single-chain Fv polypeptide) is also known to the art and described herein and, for example, in U.S. Pat. No. 5,869,620, U.S. Pat. No. 4,704,692 and U.S. Pat. No. 4,946,778. In certain embodiments all or a portion of an immunoglobulin sequence that is derived from a non-human source may be "humanized" according to recognized procedures for generating humanized antibodies, i.e., immunoglobulin sequences into which human Ig sequences are introduced to reduce the degree to which a human immune system would perceive such proteins as foreign (see, e.g., U.S. Pat. Nos. 5,693,762; 5,585,089; 4,816,567; 5,225,539; 5,530,101; and references cited therein).

Binding domain-immunoglobulin fusion proteins as described herein may, according to certain embodiments, desirably comprise sites for glycosylation, e.g., covalent attachment of carbohydrate moieties such as monosaccharides or oligosaccharides. Incorporation of amino acid sequences that provide substrates for polypeptide glycosylation is within the scope of the relevant art, including, for example, the use of genetic engineering or protein engineering methodologies to obtain a polypeptide sequence containing the classic Asn-X-Ser/Thr site for N-(asparagine)-linked glycosylation, or a sequence containing Ser or Thr residues that are suitable substrates for O-linked glycosylation, or sequences amenable to C-mannosylation, glypiation/glycosylphosphatidylinositol modification, or phosphoglycation, all of which can be identified according to art-established criteria (e.g., Spiro, 2002 *Glybiology* 12:43 R). Without wishing to be bound by theory, glycosylated fusion proteins having particular amino acid sequences may beneficially possess attributes associated with one or more of improved solubility, enhanced stability in solution, enhanced physiological stability, improved bioavailability including in vivo biodistribution, and superior resistance to proteases, all in a statistically significant manner, relative to fusion proteins having the same or highly similar amino acid sequences but lacking glycosyl moieties. In certain preferred embodiments the subject invention fusion protein comprises a glycosylation site that is present in a linker as provided herein, and in certain other preferred embodiments the subject invention fusion protein comprises a glycosylation site that is present in a hinge region polypeptide sequence as provided herein.

In certain preferred embodiments of the present invention, the binding domain-immunoglobulin fusion protein is a protein or glycoprotein that is capable of being expressed by a host cell such that it localizes to the cell surface. Binding domain-immunoglobulin fusion proteins that localize to the cell surface may do so by virtue of having naturally present or artificially introduced structural features that direct the fusion protein to the cell surface (e.g., Nelson et al. 2001 *Trends Cell Biol.* 11:483; Ammon et al., 2002 *Arch. Physiol. Biochem.* 110:137; Kasai et al., 2001 *J. Cell Sci.* 114:3115; Watson et al., 2001 *Am. J. Physiol. Cell Physiol.* 281:C215; Chatterjee et al., 200 *J. Biol. Chem.* 275:24013) including by way of illustration and not limitation, secretory signal sequences, leader sequences, plasma membrane anchor domain polypeptides such as hydrophobic transmembrane domains (e.g., Heuck et al., 2002 *Cell Biochem. Biophys.* 36:89; Sadlish et al., 2002 *Biochem J.* 364:777; Phoenix et al., 2002 *Mol. Membr. Biol.* 19:1; Minke et al., 2002 *Physiol. Rev.* 82:429) or glycosylphosphatidylinositol attachment sites ("glypiation" sites, e.g., Chatterjee et al., 2001 *Cell Mol. Life. Sci.* 58:1969; Hooper, 2001 *Proteomics* 1:748; Spiro, 2002 *Glycobiol.* 12:43 R), cell surface receptor binding domains, extracellular matrix binding domains, or any other structural feature that causes the fusion protein to localize to the cell surface. Particularly preferred are fusion proteins that comprise a plasma membrane anchor domain which includes a transmembrane polypeptide domain, typically comprising a membrane spanning domain which includes a hydrophobic region capable of energetically favorable interaction with the phospholipid fatty acyl tails that form the interior of the plasma membrane bilayer. Such features are well known to those of ordinary skill in the art, who will further be familiar with methods for introducing nucleic acid sequences encoding these features into the subject expression constructs by genetic engineering, and with routine testing of such constructs to verify cell surface localization of the product.

According to certain further embodiments, a plasma membrane anchor domain polypeptide comprises such a transmembrane domain polypeptide and also comprises a cytoplasmic tail polypeptide, which refers to a region or portion of the polypeptide sequence that contacts the cytoplasmic face of the plasma membrane and/or is in contact with the cytosol or other cytoplasmic components. A large number of cytoplasmic tail polypeptides are known that comprise the intracellular portions of plasma membrane transmembrane proteins, and discrete functions have been identified for many such polypeptides, including biological signal transduction (e.g., activation or inhibition of protein kinases, protein phosphatases, G-proteins, cyclic nucleotides and other second messengers, ion channels, secretory pathways), biologically active mediator release, stable or dynamic association with one or more cytoskeletal components, cellular differentiation, cellular activation, mitogenesis, cytostasis, apoptosis and the like (e.g., Maher et al., 2002 *Immunol. Cell Biol.* 80:131; El Far et al., 2002 *Biochem J.* 365:329; Teng et al., 2002 *Genome Biol.* 2REVIEWS:3012; Simons et al., 2001 *Cell Signal* 13:855; Furie et al., 2001 *Thromb. Haemost.* 86:214; Gaffen, 2001 *Cytokine* 14:63; Dittel, 2000 *Arch. Immunol. Ther. Exp.* (Warsz.) 48:381; Parnes et al., 2000 *Immunol. Rev.* 176:75; Moretta et al., 2000 *Semin. Immunol.* 12:129; Ben Ze'ev, 1999 *Ann. N.Y. Acad. Sci.* 886:37; Marsters et al., *Recent Prog. Horm. Res.* 54:225).

In the context of methods of using binding domain-immunoglobulin fusion proteins for the treatment of a malignant condition or a B-cell disorder as provided herein, the present invention contemplates certain embodiments wherein a binding domain-immunoglobulin fusion protein that comprises a plasma membrane anchor domain polypeptide is expressed at a cell surface and further comprises a cytoplasmic tail polypeptide which comprises an apoptosis signaling polypeptide sequence. A number of apoptosis signaling polypeptide sequences are known to the art, as reviewed, for example, in *When Cells Die: A Comprehensive Evaluation of Apoptosis and Programmed Cell Death* (R. A. Lockshin et al., Eds., 1998 John Wiley & Sons, New York; see also, e.g., Green et al., 1998 *Science* 281:1309 and references cited therein; Ferreira et al., 2002 *Clin. Canc. Res.* 8:2024; Gurumurthy et al., 2001 *Cancer Metastas. Rev.* 20:225; Kanduc et al., 2002 *Int. J. Oncol.* 21:165). Typically an apoptosis signaling polypeptide sequence comprises all or a portion of, or is derived from, a receptor death domain polypeptide, for instance, FADD (e.g., Genbank Acc. Nos. U24231, U43184, AF009616, AF009617, NM_012115), TRADD (e.g., Genbank Acc. No. NM_003789), RAIDD (e.g., Genbank Acc. No. U87229), CD95 (FAS/Apo-1; e.g., Genbank Acc. Nos. X89101, NM_003824, AF344850, AF344856), TNF-α-receptor-1 (TNFR1, e.g., Genbank Acc. Nos. S63368, AF040257), DR5 (e.g., Genbank Acc. No. AF020501, AF016268, AF012535), an ITIM domain (e.g., Genbank Acc. Nos. AF081675, BC015731, NM_006840, NM_006844, NM_006847, XM_017977; see, e.g., Billadeau et al., 2002 *J. Clin. Invest.* 109:161), an ITAM domain (e.g., Genbank Acc. Nos. NM_005843, NM003473, BC030586; see, e.g., Billadeau et al., 2002), or other apoptosis-associated receptor death domain polypeptides known to the art, for example, TNFR2 (e.g., Genbank Acc. No. L49431, L49432), caspase/procaspase-3 (e.g., Genbank Acc. No. XM_54686), caspase/procaspase-8 (e.g., AF380342, NM_004208, NM_001228, NM_033355, NM_033356, NM_033357, NM_033358), caspase/procaspase-2 (e.g., Genbank Acc. No. AF314174, AF314175), etc.

Cells in a biological sample that are suspected of undergoing apoptosis may be examined for morphological, permeability or other changes that are indicative of an apoptotic state. For example by way of illustration and not limitation, apoptosis in many cell types may cause altered morphological appearance such as plasma membrane blebbing, cell shape change, loss of substrate adhesion properties or other morphological changes that can be readily detected by a person having ordinary skill in the art, for example by using light microscopy. As another example, cells undergoing apoptosis may exhibit fragmentation and disintegration of chromosomes, which may be apparent by microscopy and/or through the use of DNA-specific or chromatin-specific dyes that are known in the art, including fluorescent dyes. Such cells may also exhibit altered plasma membrane permeability properties as may be readily detected through the use of vital dyes (e.g., propidium iodide, trypan blue) or by the detection of lactate dehydrogenase leakage into the extracellular milieu. These and other means for detecting apoptotic cells by morphologic criteria, altered plasma membrane permeability and related changes will be apparent to those familiar with the art.

In another embodiment of the invention wherein a binding domain-immunoglobulin fusion protein that is expressed at a cell surface comprises a plasma membrane anchor domain having a transmembrane domain and a cytoplasmic tail that comprises an apoptosis signaling polypeptide, cells in a biological sample may be assayed for translocation of cell membrane phosphatidylserine (PS) from the inner to the outer leaflet of the plasma membrane, which may be detected, for example, by measuring outer leaflet binding by the PS-specific protein annexin. (Martin et al., *J. Exp. Med.* 182:1545, 1995; Fadok et al., *J. Immunol.* 148:2207, 1992.). In still other related embodiments of the invention, including embodiments wherein the binding domain-immunoglobulin fusion protein is expressed at the cell surface and comprises a plasma membrane anchor domain having an apoptosis signaling polypeptide and also including embodiments wherein the binding domain-immunoglobulin fusion protein is a soluble protein that lacks a membrane anchor domain and that is capable of inducing apoptosis, a cellular response to an apoptogen is determined by an assay for induction of specific protease activity in any member of a family of apoptosis-activated proteases known as the caspases (see, e.g., Green et al., 1998 *Science* 281:1309). Those having ordinary skill in the art will be readily familiar with methods for determining caspase activity, for example by determination of caspase-mediated cleavage of specifically recognized protein substrates. These substrates may include, for example, poly-(ADP-ribose) polymerase (PARP) or other naturally occurring or synthetic peptides and proteins cleaved by caspases that are known in the art (see, e.g., Ellerby et al., 1997 *J. Neurosci.* 17:6165). Non-limiting examples of substrates include nuclear proteins such as U1-70 kDa and DNA-PKcs (Rosen and Casciola-Rosen, 1997 *J. Cell. Biochem.* 64:50; Cohen, 1997 *Biochem. J.* 326:1). Cellular apoptosis may also be detected by determination of cytochrome c that has escaped from mitochondria in apoptotic cells (e.g., Liu et al., *Cell* 86:147, 1996). Such detection of cytochrome c may be performed spectrophotometrically, immunochemically or by other well established methods for determining the presence of a specific protein. Persons having ordinary skill in the art will readily appreciate that there may be other suitable techniques for quantifying apoptosis.

Once a binding domain-immunoglobulin fusion protein as provided herein has been designed, DNAs encoding the polypeptide may be synthesized via oligonucleotide synthesis as described, for example, in Sinha et al., *Nucleic Acids Res.*, 12, 4539-4557 (1984); assembled via PCR as described, for example in Innis, Ed., *PCR Protocols*, Academic Press (1990) and also in Better et al. *J. Biol. Chem.* 267, 16712-16118 (1992); cloned and expressed via standard procedures as described, for example, in Ausubel et al., Eds., *Current Protocols in Molecular Biology*, John Wiley & Sons, N.Y. (1989) and also in Robinson et al., *Hum. Antibod. Hybridomas*, 2, 84-93 (1991); and tested for specific antigen binding activity, as described, for example, in Harlow et al., Eds., *Antibodies: A Laboratory Manual*, Chapter 14, Cold Spring Harbor Laboratory, Cold Spring Harbor (1988) and Munson et al., *Anal. Biochem.*, 107, 220-239 (1980).

The preparation of single polypeptide chain binding molecules of the Fv region, single-chain Fv molecules, is described in U.S. Pat. No. 4,946,778, which is incorporated herein by reference. In the present invention, single-chain Fv-like molecules are synthesized by encoding a first variable region of the heavy or light chain, followed by one or more linkers to the variable region of the corresponding light or heavy chain, respectively. The selection of appropriate linker(s) between the two variable regions is described in U.S. Pat. No. 4,946,778 (see also, e.g., Huston et al., 1993 *Int. Rev. Immunol.* 10:195). An exemplary linker described herein is (Gly-Gly-Gly-Gly-Ser)$_3$. The linker is used to convert the naturally aggregated but chemically separate heavy and light chains into the amino terminal antigen binding portion of a single polypeptide chain, wherein this antigen binding portion will fold into a structure similar to the original structure made of two polypeptide chains and thus retain the ability to bind to the antigen of interest. The nucleotide sequences encoding the variable regions of the heavy and light chains, joined by a sequence encoding a linker, are joined to a nucleotide sequence encoding antibody constant regions. The constant regions are those which permit the resulting polypeptide to form interchain disulfide bonds to form a dimer, and which contain desired effector functions, such as the ability to mediate antibody-dependent cellular cytotoxicity (ADCC). For an immunoglobulin-like molecule of the invention which is intended for use in humans, the constant regions will typically be substantially human to minimize a potential anti-human immune response and to provide appropriate effector functions. Manipulation of sequences encoding antibody constant regions is described in the PCT publication of Morrison and Oi, WO 89/07142, which is incorporated herein by reference. In preferred embodiments, the CH1 domain is deleted and the carboxyl end of the binding domain polypeptide (e.g., an immunoglobulin variable region polypeptide) is joined to the amino terminus of CH2 via a hinge region polypeptide as provided herein.

As described above, the present invention provides recombinant expression constructs capable of directing the expression of binding domain-immunoglobulin fusion proteins as provided herein. The amino acids, which occur in the various amino acid sequences referred to herein, are identified according to their well known three-letter or single-letter abbreviations. The nucleotides, which occur in the various DNA sequences or fragments thereof referred herein, are designated with the standard single letter designations used routinely in the art. A given amino acid sequence may also encompass similar amino acid sequences having only minor changes, for example by way of illustration and not limitation, covalent chemical modifications, insertions, deletions and substitutions, which may further include conservative substitutions. Amino acid sequences that are similar to one another may share substantial regions of sequence homology. In like fashion, nucleotide sequences may encompass substantially similar nucleotide sequences having only minor changes, for example by way of illustration and not limitation, covalent chemical modifications, insertions, deletions and substitutions, which may further include silent mutations owing to degeneracy of the genetic code. Nucleotide sequences that are similar to one another may share substantial regions of sequence homology.

The presence of a malignant condition in a subject refers to the presence of dysplastic, cancerous and/or transformed cells in the subject, including, for example neoplastic, tumor, non-contact inhibited or oncogenically transformed cells, or the like (e.g., melanoma, carcinomas such as adenocarcinoma, squamous cell carcinoma, small cell carcinoma, oat cell carcinoma, etc., sarcomas such as chondrosarcoma, osteosarcoma, etc.) which are known to the art and for which criteria for diagnosis and classification are established. In preferred embodiments contemplated by the present invention, for example, such cancer cells are malignant hematopoietic cells, such as transformed cells of lymphoid lineage and in particular, B-cell lymphomas and the like; cancer cells may in certain preferred embodiments also be epithelial cells such as carcinoma cells. The invention also contemplates B-cell disorders, which may include certain malignant conditions that affect B-cells (e.g., B-cell lymphoma) but which is not intended to be so limited, and which is also intended to encompass autoimmune diseases and in particular, diseases, disorders and conditions that are characterized by autoantibody production.

Autoantibodies are antibodies that react with self antigens. Autoantibodies are detected in several autoimmune diseases (i.e., a disease, disorder or condition wherein a host immune system generates an inappropriate anti-"self" immune reaction) where they are involved in disease activity. The current treatments for these autoimmune diseases are immunosuppressive drugs that require continuing administration, lack specificity, and cause significant side effects. New approaches that can eliminate autoantibody production with minimal toxicity will address an unmet medical need for a spectrum of diseases that affect many people. The subject invention binding domain-immunoglobulin fusion protein is designed for improved penetration into lymphoid tissues. Depletion of B lymphocytes interrupts the autoantibody production cycle, and allows the immune system to reset as new B lymphocytes are produced from precursors in the bone marrow.

A number of diseases have been identified for which beneficial effects are believed, according to non-limiting theory, to result from B cell depletion therapy; a brief description of several exemplars of these diseases follows.

Autoimmune thyroid disease includes Graves' disease and Hashimoto's thyroiditis. In the United States alone, there are about 20 million people who have some form of autoimmune thyroid disease. Autoimmune thyroid disease results from the production of autoantibodies that either stimulate the thyroid to cause hyperthyroidism (Graves' disease) or destroy the thyroid to cause hypothyroidism (Hashimoto's thyroiditis). Stimulation of the thyroid is caused by autoantibodies that bind and activate the thyroid stimulating hormone (TSH) receptor. Destruction of the thyroid is caused by autoantibodies that react with other thyroid antigens.

Current therapy for Graves' disease includes surgery, radioactive iodine, or antithyroid drug therapy. Radioactive iodine is widely used, since antithyroid medications have significant side effects and disease recurrence is high. Surgery is reserved for patients with large goiters or where there is a need for very rapid normalization of thyroid function. There are no therapies that target the production of autoantibodies responsible for stimulating the TSH receptor. Current therapy for Hashimoto's thyroiditis is levothyroxine sodium, and therapy is usually lifelong because of the low likelihood of remission. Suppressive therapy has been shown to shrink goiters in Hashimoto's thryroiditis, but no therapies that reduce autoantibody production to target the disease mechanism are known.

Rheumatoid arthritis (RA) is a chronic disease characterized by inflammation of the joints, leading to swelling, pain, and loss of function. RA effects an estimated 2.5 million people in the United States. RA is caused by a combination of events including an initial infection or injury, an abnormal immune response, and genetic factors. While autoreactive T cells and B cells are present in RA, the detection of high levels of antibodies that collect in the joints, called rheumatoid factor, is used in the diagnosis of RA. Current therapy for RA includes many medications for managing pain and slowing the progression of the disease. No therapy has been found that can cure the disease. Medications include nonsteroidal anti-inflammatory drugs (NSAIDS), and disease modifying anti-rheumatic drugs (DMARDS). NSAIDS are effective in benign disease, but fail to prevent the progression to joint destruction and debility in severe RA. Both NSAIDS and DMARDS are associated with significant side effects. Only one new DMARD, Leflunomide, has been approved in over 10 years. Leflunomide blocks production of autoantibodies, reduces inflammation, and slows progression of RA. However, this drug also causes severe side effects including nausea, diarrhea, hair loss, rash, and liver injury.

Systemic Lupus Erythematosus (SLE) is an autoimmune disease caused by recurrent injuries to blood vessels in multiple organs, including the kidney, skin, and joints. SLE effects over 500,000 people in the United States. In patients with SLE, a faulty interaction between T cells and B cells results in the production of autoantibodies that attack the cell nucleus. These include anti-double stranded DNA and anti-Sm antibodies. Autoantibodies that bind phospholipids are also found in about half of SLE patients, and are responsible for blood vessel damage and low blood counts. Immune complexes accumulate the kidneys, blood vessels, and joints of SLE patients, where they cause inflammation and tissue damage. No treatment for SLE has been found to cure the disease. NSAIDS and DMARDS are used for therapy depending upon the severity of the disease. Plasmapheresis with plasma exchange to remove autoantibodies can cause temporary improvement in SLE patients. There is general agreement that autoantibodies are responsible for SLE, so new therapies that deplete the B cell lineage, allowing the immune system to reset as new B cells are generated from precursors, offer hope for long lasting benefit in SLE patients.

Sjogrens syndrome is an autoimmune disease characterized by destruction of the body's moisture producing glands. Sjogrens syndrome is one of the most prevelant autoimmune disorders, striking up to 4 million people in the United States. About half of people with Sjogren's also have a connective tissue disease, such as rheumatoid arthritis, while the other half have primary Sjogren's with no other concurrent autoimmune disease. Autoantibodies, including anti-nuclear antibodies, rheumatoid factor, anti-fodrin, and anti-muscarinic receptor are often present in patients with Sjogrens syndrome. Conventional therapy includes corticosteroids.

Immune Thrombocytopenic purpura (ITP) is caused by autoantibodies that bind to blood platelets and cause their destruction. Some cases of ITP are caused by drugs, and others are associated with infection, pregnancy, or autoimmune disease such as SLE. About half of all cases are classified as "idiopathic", meaning the cause is unknown. The treatment of ITP is determined by the severity of the symptoms. In some cases, no therapy is needed. In most cases, immunosuppressive drugs, including corticosteroids or intravenous infusions of immune globulin to deplete T cells. Another treatment that usually results in an increased number of platelets is removal of the spleen, the organ that destroys antibody-coated platelets. More potent immunosuppressive drugs, including cyclosporine, cyclophosphamide, or azathioprine are used for patients with severe cases. Removal of autoantibodies by passage of patients' plasma over a Protein A column is used as a second line treatment in patients with severe disease.

Multiple Sclerosis (MS) is an autoimmune disease characterized by inflammation of the central nervous system and destruction of myelin, which insulates nerve cell fibers in the brain, spinal cord, and body. Although the cause of MS is unknown, it is widely believed that autoimmune T cells are primary contributors to the pathogenesis of the disease. However, high levels of antibodies are present in the cerebral spinal fluid of patients with MS, and some theories predict that the B cell response leading to antibody production is important for mediating the disease. No B cell depletion therapies have been studies in patients with MS. There is no cure for MS. Current therapy is corticosteroids, which can reduce the duration and severity of attacks, but do not affect the course of MS over time. New biotechnology interferon (IFN) therapies for MS have recently been approved.

Myasthenia Gravis (MG) is a chronic autoimmune neuromuscular disorder that is characterized by weakness of the voluntary muscle groups. MG effects about 40,000 people in the United States. MG is caused by autoantibodies that bind to acetylcholine receptors expressed at neuromuscular junctions. The autoantibodies reduce or block acetylcholine receptors, preventing the transmission of signals from nerves to muscles. There is no known cure for MG. Common treatments include immunosuppression with corticosteroids, cyclosporine, cyclophosphamide, or azathioprine. Surgical removal of the thymus is often used to blunt the autoimmune response. Plasmapheresis, used to reduce autoantibody levels in the blood, is effective in MG, but is short-lived because the production of autoantibodies continues. Plasmapheresis is usually reserved for severe muscle weakness prior to surgery.

Psoriasis effects approximately five million people. Autoimmune inflammation in the skin. Psoriasis associated with arthritis in 30% (psoriatic arthritis). Many treatments, including steroids, UV light retenoids, vitamin D derivatives, cyclosporine, methotrexate.

Scleroderma is a chronic autoimmune disease of the connective tissue that is also known as systemic sclerosis. Scleroderma is characterized by an overproduction of collagen, resulting in a thickening of the skin. Approximately 300,000 people in the United States have scleroderma.

Inflammatory Bowel Disease including Crohn's disease and Ulcerative colitis, are autoimmune diseases of the digestive system.

The present invention further relates to constructs encoding binding domain-immunoglobulin fusion proteins, and in particular to methods for administering recombinant constructs encoding such proteins that may be expressed, for example, as fragments, analogs and derivatives of such polypeptides. The terms "fragment," "derivative" and "analog" when referring to binding domain-immunoglobulin fusion polypeptides or fusion proteins, refers to any binding domain-immunoglobulin fusion polypeptide or fusion protein that retains essentially the same biological function or activity as such polypeptide. Thus, an analog includes a proprotein which can be activated by cleavage of the proprotein portion to produce an active binding domain-immunoglobulin fusion polypeptide.

A fragment, derivative or analog of an binding domain-immunoglobulin fusion polypeptide or fusion protein, including binding domain-immunoglobulin fusion polypeptides or fusion proteins encoded by the cDNAs referred to herein, may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which additional amino acids are fused to the binding domain-immunoglobulin fusion polypeptide, including amino acids that are employed for detection or specific functional alteration of the binding domain-immunoglobulin fusion polypeptide or a proprotein sequence. Such fragments, derivatives and analogs are deemed to be within the scope of those skilled in the art from the teachings herein.

The polypeptides of the present invention include binding domain-immunoglobulin fusion polypeptides and fusion proteins having binding domain polypeptide amino acid sequences that are identical or similar to sequences known in the art, or fragments or portions thereof. For example by way of illustration and not a human CD154 molecule extracellular domain is contemplated for use according to the instant invention, as are polypeptides having at least 70% similarity (preferably a 70% identity) and more preferably 90% similarity (more preferably a 90% identity) to the reported polypeptide and still more preferably a 95% similarity (still more preferably a 95% identity) to the reported polypeptides and to portions of such polypeptides, wherein such portions of a binding domain-immunoglobulin fusion polypeptide generally contain at least 30 amino acids and more preferably at least 50 amino acids. Extracellular domains include portions of a cell surface molecule, and in particularly preferred embodiments cell surface molecules that are integral membrane proteins or that comprise a plasma membrane spanning transmembrane domain, that extend beyond the outer leaflet of the plasma membrane phospholipid bilayer when the molecule is expressed at a cell surface, preferably in a manner that exposes the extracellular domain portion of such a molecule to the external environment of the cell, also known as the extracellular milieu. Methods for determining whether a portion of a cell surface molecule comprises an extracellular domain are well known to the art and include experimental determination (e.g., direct or indirect labeling of the molecule, evaluation of whether the molecule can be structurally altered by agents to which the plasma membrane is not permeable such as proteolytic or lipolytic enzymes) or topological prediction based on the structure of the molecule (e.g., analysis of the amino acid sequence of a polypeptide) or other methodologies.

As known in the art "similarity" between two polypeptides is determined by comparing the amino acid sequence and conserved amino acid substitutes thereto of the polypeptide to the sequence of a second polypeptide. Fragments or portions of the nucleic acids encoding polypeptides of the present invention may be used to synthesize full-length nucleic acids of the present invention. As used herein, "% identity" refers to the percentage of identical amino acids situated at corresponding amino acid residue positions when two or more polypeptide are aligned and their sequences analyzed using a gapped BLAST algorithm (e.g., Altschul et al., 1997 *Nucl. Ac. Res.* 25:3389) which weights sequence gaps and sequence mismatches according to the default weightings provided by the National Institutes of Health/NCBI database (Bethesda, Md.).

The term "isolated" means that the material is removed from its original environment (e.g., the natural environment if it is naturally occurring). For example, a naturally occurring nucleic acid or polypeptide present in a living animal is not isolated, but the same nucleic acid or polypeptide, separated from some or all of the co-existing materials in the natural system, is isolated. Such nucleic acids could be part of a vector and/or such nucleic acids or polypeptides could be part of a composition, and still be isolated in that such vector or composition is not part of its natural environment.

The term "gene" means the segment of DNA involved in producing a polypeptide chain; it includes regions preceding and following the coding region "leader and trailer" as well as intervening sequences (introns) between individual coding segments (exons).

As described herein, the invention provides binding domain-immunoglobulin fusion proteins encoded by nucleic acids that have the binding domain coding sequence fused in frame to an additional immunoglobulin domain encoding sequence to provide for expression of a binding domain polypeptide sequence fused to an additional functional polypeptide sequence that permits, for example by way of illustration and not limitation, detection, functional alteration, isolation and/or purification of the fusion protein. Such fusion proteins may permit functional alteration of a binding domain by containing additional immunoglobulin-derived polypeptide sequences that influence behavior of the fusion product, for example (and as described above) by reducing the availability of sulfhydryl groups for participation in disulfide bond formation, and by conferring the ability to potentiate ADCC and/or CDC.

Modification of the polypeptide may be effected by any means known to those of skill in this art. The preferred methods herein rely on modification of DNA encoding the fusion protein and expression of the modified DNA. DNA encoding one of the binding domain-immunoglobulin fusions discussed above may be mutagenized using standard methodologies, including those described below. For example, cysteine residues that may otherwise facilitate multimer formation or promote particular molecular conformations can be deleted from a polypeptide or replaced, e.g., cysteine residues that are responsible for aggregate formation. If necessary, the identity of cysteine residues that contribute to aggregate formation may be determined empirically, by deleting and/or replacing a cysteine residue and ascertaining whether the resulting protein aggregates in solutions containing physiologically acceptable buffers and salts. In addition, fragments of binding domain-immunoglobulin fusions may be constructed and used. As noted above, the counterreceptor/ligand binding domains for many candidate binding domain-immunoglobulin fusion have been delineated, such that one having ordinary skill in the art may readily select appropriate polypeptide domains for inclusion in the encoded products of the instant expression constructs.

Conservative substitutions of amino acids are well-known and may be made generally without altering the biological activity of the resulting binding domain-immunoglobulin fusion protein molecule. For example, such substitutions are generally made by interchanging within the groups of polar residues, charged residues, hydrophobic residues, small residues, and the like. If necessary, such substitutions may be determined empirically merely by testing the resulting modified protein for the ability to bind to the appropriate cell surface receptors in in vitro biological assays, or to bind to appropriate antigens or desired target molecules.

The present invention further relates to nucleic acids which hybridize to binding domain-immunoglobulin fusion protein encoding polynucleotide sequences as provided herein, or their complements, as will be readily apparent to those familiar with the art, if there is at least 70%, preferably 80-85%, more preferably at least 90%, and still more preferably at least 95%, 96%, 97%, 98% or 99% identity between the sequences. The present invention particularly relates to nucleic acids which hybridize under stringent conditions to the binding domain-immunoglobulin fusion encoding nucleic acids referred to herein. As used herein, the term "stringent conditions" means hybridization will occur only if there is at least 90-95% and preferably at least 97% identity between the sequences. The nucleic acids which hybridize to binding domain-immunoglobulin fusion encoding nucleic acids referred to herein, in preferred embodiments, encode polypeptides which retain substantially the same biological function or activity as the binding domain-immunoglobulin fusion polypeptides encoded by the cDNAs of the references cited herein.

As used herein, to "hybridize" under conditions of a specified stringency is used to describe the stability of hybrids formed between two single-stranded nucleic acid molecules. Stringency of hybridization is typically expressed in conditions of ionic strength and temperature at which such hybrids are annealed and washed. Typically "high", "medium" and "low" stringency encompass the following conditions or equivalent conditions thereto: high stringency: 0.1×SSPE or SSC, 0.1% SDS, 65° C.; medium stringency: 0.2×SSPE or SSC, 0.1% SDS, 50° C.; and low stringency: 1.0×SSPE or SSC, 0.1% SDS, 50° C. As known to those having ordinary skill in the art, variations in stringency of hybridization conditions may be achieved by altering the time, temperature and/or concentration of the solutions used for prehybridization, hybridization and wash steps, and suitable conditions may also depend in part on the particular nucleotide sequences of the probe used, and of the blotted, proband nucleic acid sample. Accordingly, it will be appreciated that suitably stringent conditions can be readily selected without undue experimentation where a desired selectivity of the probe is identified, based on its ability to hybridize to one or more certain proband sequences while not hybridizing to certain other proband sequences.

The nucleic acids of the present invention, also referred to herein as polynucleotides, may be in the form of RNA or in the form of DNA, which DNA includes cDNA, genomic DNA, and synthetic DNA. The DNA may be double-stranded or single-stranded, and if single stranded may be the coding strand or non-coding (anti-sense) strand. A coding sequence which encodes an binding domain-immunoglobulin fusion polypeptide for use according to the invention may be identical to the coding sequence known in the art for any given binding domain-immunoglobulin fusion, or may be a different coding sequence, which, as a result of the redundancy or degeneracy of the genetic code, encodes the same binding domain-immunoglobulin fusion polypeptide.

The nucleic acids which encode binding domain-immunoglobulin fusion polypeptides for use according to the invention may include, but are not limited to: only the coding sequence for the binding domain-immunoglobulin fusion polypeptide; the coding sequence for the binding domain-immunoglobulin fusion polypeptide and additional coding sequence; the coding sequence for the binding domain-immunoglobulin fusion polypeptide (and optionally additional coding sequence) and non-coding sequence, such as introns or non-coding sequences 5' and/or 3' of the coding sequence for the binding domain-immunoglobulin fusion polypeptide, which for example may further include but need not be limited to one or more regulatory nucleic acid sequences that may be a regulated or regulatable promoter, enhancer, other transcription regulatory sequence, repressor binding sequence, translation regulatory sequence or any other regulatory nucleic acid sequence. Thus, the term "nucleic acid encoding" or "polynucleotide encoding" a binding domain-immunoglobulin fusion protein encompasses a nucleic acid which includes only coding sequence for a binding domain-immunoglobulin fusion polypeptide as well as a nucleic acid which includes additional coding and/or non-coding sequence(s).

Nucleic acids and oligonucleotides for use as described herein can be synthesized by any method known to those of skill in this art (see, e.g., WO 93/01286, U.S. application Ser. No. 07/723,454; U.S. Pat. No. 5,218,088; U.S. Pat. No. 5,175,269; U.S. Pat. No. 5,109,124). Identification of oligonucleotides and nucleic acid sequences for use in the present invention involves methods well known in the art. For example, the desirable properties, lengths and other characteristics of useful oligonucleotides are well known. In certain embodiments, synthetic oligonucleotides and nucleic acid sequences may be designed that resist degradation by endogenous host cell nucleolytic enzymes by containing such linkages as: phosphorothioate, methylphosphonate, sulfone, sulfate, ketyl, phosphorodithioate, phosphoramidate, phosphate esters, and other such linkages that have proven useful in antisense applications (see, e.g., Agrwal et al., *Tetrehedron Lett.* 28:3539-3542 (1987); Miller et al., *J. Am. Chem. Soc.* 93:6657-6665 (1971); Stec et al., *Tetrehedron Lett.* 26:2191-2194 (1985); Moody et al., *Nucl. Acids Res.* 12:4769-4782 (1989); Uznanski et al., *Nucl. Acids Res.* (1989); Letsinger et al., *Tetrahedron* 40:137-143 (1984); Eckstein, *Annu. Rev. Biochem.* 54:367-402 (1985); Eckstein, *Trends Biol. Sci.* 14:97-100 (1989); Stein In: *Oligodeoxynucleotides. Antisense Inhibitors of Gene Expression*, Cohen, Ed, Macmillan Press, London, pp. 97-117 (1989); Jager et al., *Biochemistry* 27:7237-7246 (1988)).

In one embodiment, the present invention provides truncated components (e.g., binding domain polypeptide, hinge region polypeptide, linker, etc.) for use in a binding domain-immunoglobulin fusion protein, and in another embodiment the invention provides nucleic acids encoding a binding domain-immunoglobulin fusion protein having such truncated components. A truncated molecule may be any molecule that comprises less than a full length version of the molecule. Truncated molecules provided by the present invention may include truncated biological polymers, and in preferred embodiments of the invention such truncated molecules may be truncated nucleic acid molecules or truncated polypeptides. Truncated nucleic acid molecules have less than the full length nucleotide sequence of a known or described nucleic acid molecule, where such a known or described nucleic acid molecule may be a naturally occurring, a synthetic or a recombinant nucleic acid molecule, so long as one skilled in the art would regard it as a full length molecule. Thus, for example, truncated nucleic acid molecules that correspond to a gene sequence contain less than the full length gene where the gene comprises coding and non-coding sequences, promoters, enhancers and other regulatory sequences, flanking sequences and the like, and other functional and non-functional sequences that are recognized as part of the gene. In another example, truncated nucleic acid molecules that correspond to a mRNA sequence contain less than the full length mRNA transcript, which may include various translated and non-translated regions as well as other functional and non-functional sequences.

In other preferred embodiments, truncated molecules are polypeptides that comprise less than the full length amino acid sequence of a particular protein or polypeptide component. As used herein "deletion" has its common meaning as understood by those familiar with the art, and may refer to molecules that lack one or more of a portion of a sequence from either terminus or from a non-terminal region, relative to a corresponding full length molecule, for example, as in the case of truncated molecules provided herein. Truncated molecules that are linear biological polymers such as nucleic acid molecules or polypeptides may have one or more of a deletion from either terminus of the molecule or a deletion from a non-terminal region of the molecule, where such deletions may be deletions of 1-1500 contiguous nucleotide or amino acid residues, preferably 1-500 contiguous nucleotide or amino acid residues and more preferably 1-300 contiguous nucleotide or amino acid residues, including deletions of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31-40, 41-50, 51-74, 75-100, 101-150, 151-200, 201-250 or 251-299 contiguous nucleotide or amino acid residues. In certain particularly preferred embodiments truncated nucleic acid molecules may have a deletion of 270-330 contiguous nucleotides. In certain other particularly preferred embodiments truncated polypeptide molecules may have a deletion of 80-140 contiguous amino acids.

The present invention further relates to variants of the herein referenced nucleic acids which encode fragments, analogs and/or derivatives of a binding domain-immunoglobulin fusion polypeptide. The variants of the nucleic acids encoding binding domain-immunoglobulin fusion may be naturally occurring allelic variants of the nucleic acids or non-naturally occurring variants. As is known in the art, an allelic variant is an alternate form of a nucleic acid sequence which may have at least one of a substitution, a deletion or an addition of one or more nucleotides, any of which does not substantially alter the function of the encoded binding domain-immunoglobulin fusion polypeptide.

Variants and derivatives of binding domain-immunoglobulin fusion may be obtained by mutations of nucleotide sequences encoding binding domain-immunoglobulin fusion polypeptides or any portion thereof. Alterations of the native amino acid sequence may be accomplished by any of a number of conventional methods. Mutations can be introduced at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion.

Alternatively, oligonucleotide-directed site-specific mutagenesis procedures can be employed to provide an altered gene wherein predetermined codons can be altered by substitution, deletion or insertion. Exemplary methods of making such alterations are disclosed by Walder et al. (*Gene* 42:133, 1986); Bauer et al. (*Gene* 37:73, 1985); Craik (*BioTechniques*, January 1985, 12-19); Smith et al. (*Genetic Engineering: Principles and Methods BioTechniques*, January 1985, 12-19); Smith et al. (*Genetic Engineering: Principles and Methods*, Plenum Press, 1981); Kunkel (*Proc. Natl. Acad. Sci. USA* 82:488, 1985); Kunkel et al. (*Methods in Enzymol.* 154:367, 1987); and U.S. Pat. Nos. 4,518,584 and 4,737,462.

As an example, modification of DNA may be performed by site-directed mutagenesis of DNA encoding the protein combined with the use of DNA amplification methods using primers to introduce and amplify alterations in the DNA template, such as PCR splicing by overlap extension (SOE). Site-directed mutagenesis is typically effected using a phage vector that has single- and double-stranded forms, such as M13 phage vectors, which are well-known and commercially available. Other suitable vectors that contain a single-stranded phage origin of replication may be used (see, e.g., Veira et al., *Meth. Enzymol.* 15:3, 1987). In general, site-directed mutagenesis is performed by preparing a single-stranded vector that encodes the protein of interest (e.g., all or a component portion of a given binding domain-immunoglobulin fusion protein). An oligonucleotide primer that contains the desired mutation within a region of homology to the DNA in the single-stranded vector is annealed to the vector followed by addition of a DNA polymerase, such as *E. coli* DNA polymerase I (Klenow fragment), which uses the double stranded region as a primer to produce a heteroduplex in which one strand encodes the altered sequence and the other the original sequence. The heteroduplex is introduced into appropriate bacterial cells and clones that include the desired mutation are selected. The resulting altered DNA molecules may be expressed recombinantly in appropriate host cells to produce the modified protein.

Equivalent DNA constructs that encode various additions or substitutions of amino acid residues or sequences, or deletions of terminal or internal residues or sequences not needed for biological activity are also encompassed by the invention. For example, and as discussed above, sequences encoding Cys residues that are not desirable or essential for biological activity can be altered to cause the Cys residues to be deleted or replaced with other amino acids, preventing formation of incorrect intramolecular disulfide bridges upon renaturation.

Host organisms include those organisms in which recombinant production of binding domain-immunoglobulin fusion products encoded by the recombinant constructs of the present invention may occur, such as bacteria (for example, *E. coli*), yeast (for example, *Saccharomyces cerevisiae* and *Pichia pastoris*), insect cells and mammals, including in vitro and in vivo expression. Host organisms thus may include organisms for the construction, propagation, expression or other steps in the production of the compositions provided herein; hosts also include subjects in which immune responses take place, as described above. Presently preferred host organisms are *E. coli* bacterial strains, inbred murine strains and murine cell lines, and human cells, subjects and cell lines.

The DNA construct encoding the desired binding domain-immunoglobulin fusion is introduced into a plasmid for expression in an appropriate host. In preferred embodiments, the host is a bacterial host. The sequence encoding the ligand or nucleic acid binding domain is preferably codon-optimized for expression in the particular host. Thus, for example, if a human binding domain-immunoglobulin fusion is expressed in bacteria, the codons would be optimized for bacterial usage. For small coding regions, the gene can be synthesized as a single oligonucleotide. For larger proteins, splicing of multiple oligonucleotides, mutagenesis, or other techniques known to those in the art may be used. The sequences of nucleotides in the plasmids that are regulatory regions, such as promoters and operators, are operationally associated with one another for transcription. The sequence of nucleotides encoding a binding domain-immunoglobulin fusion protein may also include DNA encoding a secretion signal, whereby the resulting peptide is a precursor protein. The resulting processed protein may be recovered from the periplasmic space or the fermentation medium.

In preferred embodiments, the DNA plasmids also include a transcription terminator sequence. As used herein, a "transcription terminator region" is a sequence that signals transcription termination. The entire transcription terminator may be obtained from a protein-encoding gene, which may be the same or different from the inserted binding domain-immunoglobulin fusion encoding gene or the source of the promoter. Transcription terminators are optional components of the expression systems herein, but are employed in preferred embodiments.

The plasmids used herein include a promoter in operative association with the DNA encoding the protein or polypeptide of interest and are designed for expression of proteins in a suitable host as described above (e.g., bacterial, murine or human) depending upon the desired use of the plasmid (e.g., administration of a vaccine containing binding domain-immunoglobulin fusion encoding sequences). Suitable promoters for expression of proteins and polypeptides herein are widely available and are well known in the art. Inducible promoters or constitutive promoters that are linked to regulatory regions are preferred. Such promoters include, but are not limited to, the T7 phage promoter and other T7-like phage promoters, such as the T3, 15 and SP6 promoters, the trp, lpp, and lac promoters, such as the lacUV5, from *E. coli*; the P10 or polyhedrin gene promoter of baculovirus/insect cell expression systems (see, e.g., U.S. Pat. Nos. 5,243,041, 5,242,687, 5,266,317, 4,745,051, and 5,169,784) and inducible promoters from other eukaryotic expression systems. For expression of the proteins such promoters are inserted in a plasmid in operative linkage with a control region such as the lac operon.

Preferred promoter regions are those that are inducible and functional in *E. coli*. Examples of suitable inducible promoters and promoter regions include, but are not limited to: the *E. coli* lac operator responsive to isopropyl β-D-thiogalactopyranoside (IPTG; see Nakamura et al., *Cell* 18:1109-1117, 1979); the metallothionein promoter metal-regulatory-elements responsive to heavy-metal (e.g., zinc) induction (see, e.g., U.S. Pat. No. 4,870,009 to Evans et al.); the phage T7lac promoter responsive to IPTG (see, e.g., U.S. Pat. No. 4,952,496; and Studier et al., *Meth. Enzymol.* 185:60-89, 1990) and the TAC promoter.

The plasmids may optionally include a selectable marker gene or genes that are functional in the host. A selectable marker gene includes any gene that confers a phenotype on bacteria that allows transformed bacterial cells to be identified and selectively grown from among a vast majority of untransformed cells. Suitable selectable marker genes for bacterial hosts, for example, include the ampicillin resistance gene ($Amp^r$), tetracycline resistance gene ($Tc^r$) and the kanamycin resistance gene ($Kan^r$). The kanamycin resistance gene is presently preferred.

The plasmids may also include DNA encoding a signal for secretion of the operably linked protein. Secretion signals suitable for use are widely available and are well known in the art. Prokaryotic and eukaryotic secretion signals functional in *E. coli* may be employed. The presently preferred secretion signals include, but are not limited to, those encoded by the following *E. coli* genes: ompA, ompT, ompF, ompC, beta-lactamase, and alkaline phosphatase, and the like (von Heijne, *J. Mol. Biol.* 184:99-105, 1985). In addition, the bacterial pelB gene secretion signal (Lei et al., *J. Bacteriol.* 169:4379, 1987), the phoA secretion signal, and the cek2 functional in insect cell may be employed. The most preferred secretion signal is the *E. coli* ompA secretion signal. Other prokaryotic and eukaryotic secretion signals known to those of skill in the art may also be employed (see, e.g., von Heijne, *J. Mol. Biol.* 184:99-105, 1985). Using the methods described herein, one of skill in the art can substitute secretion signals that are functional in either yeast, insect or mammalian cells to secrete proteins from those cells.

Preferred plasmids for transformation of *E. coli* cells include the pET expression vectors (e.g., pET-11a, pET-12a-c, pET-15b; see U.S. Pat. No. 4,952,496; available from Novagen, Madison, Wis.). Other preferred plasmids include the pKK plasmids, particularly pKK 223-3, which contains the tac promoter (Brosius et al., *Proc. Natl. Acad. Sci.*

81:6929, 1984; Ausubel et al., *Current Protocols in Molecular Biology*; U.S. Pat. Nos. 5,122,463, 5,173,403, 5,187,153, 5,204,254, 5,212,058, 5,212,286, 5,215,907, 5,220,013, 5,223,483, and 5,229,279). Plasmid pKK has been modified by replacement of the ampicillin resistance gene with a kanamycin resistance gene. (Available from Pharmacia; obtained from pUC4K, see, e.g., Vieira et al. (*Gene* 19:259-268, 1982; and U.S. Pat. No. 4,719,179.) Baculovirus vectors, such as pBlueBac (also called pJVETL and derivatives thereof), particularly pBlueBac III (see, e.g., U.S. Pat. Nos. 5,278,050, 5,244,805, 5,243,041, 5,242,687, 5,266,317, 4,745,051, and 5,169,784; available from Invitrogen, San Diego) may also be used for expression of the polypeptides in insect cells. Other plasmids include the pIN-IIIompA plasmids (see U.S. Pat. No. 4,575,013; see also Duffaud et al., *Meth. Enz.* 153:492-507, 1987), such as pIN-IIIompA2.

Preferably, the DNA molecule is replicated in bacterial cells, preferably in *E. coli*. The preferred DNA molecule also includes a bacterial origin of replication, to ensure the maintenance of the DNA molecule from generation to generation of the bacteria. In this way, large quantities of the DNA molecule can be produced by replication in bacteria. Preferred bacterial origins of replication include, but are not limited to, the f1-ori and col E1 origins of replication. Preferred hosts contain chromosomal copies of DNA encoding T7 RNA polymerase operably linked to an inducible promoter, such as the lacUV promoter (see U.S. Pat. No. 4,952,496). Such hosts include, but are not limited to, lysogens *E. coli* strains HMS174(DE3)pLysS, BL21(DE3)pLysS, HMS174(DE3) and BL21(DE3). Strain BL21(DE3) is preferred. The pLys strains provide low levels of T7 lysozyme, a natural inhibitor of T7 RNA polymerase.

The DNA molecules provided may also contain a gene coding for a repressor protein. The repressor protein is capable of repressing the transcription of a promoter that contains sequences of nucleotides to which the repressor protein binds. The promoter can be derepressed by altering the physiological conditions of the cell. For example, the alteration can be accomplished by adding to the growth medium a molecule that inhibits the ability to interact with the operator or with regulatory proteins or other regions of the DNA or by altering the temperature of the growth media. Preferred repressor proteins include, but are not limited to the *E. coli* lad repressor responsive to IPTG induction, the temperature sensitive λ, cI857 repressor, and the like. The *E. coli* lad repressor is preferred.

In general, recombinant constructs of the subject invention will also contain elements necessary for transcription and translation. In particular, such elements are preferred where the recombinant expression construct containing nucleic acid sequences encoding binding domain-immunoglobulin fusion proteins is intended for expression in a host cell or organism. In certain embodiments of the present invention, cell type preferred or cell type specific expression of a cell binding domain-immunoglobulin fusion encoding gene may be achieved by placing the gene under regulation of a promoter. The choice of the promoter will depend upon the cell type to be transformed and the degree or type of control desired. Promoters can be constitutive or active and may further be cell type specific, tissue specific, individual cell specific, event specific, temporally specific or inducible. Cell-type specific promoters and event type specific promoters are preferred. Examples of constitutive or nonspecific promoters include the SV40 early promoter (U.S. Pat. No. 5,118,627), the SV40 late promoter (U.S. Pat. No. 5,118,627), CMV early gene promoter (U.S. Pat. No. 5,168,062), and adenovirus promoter. In addition to viral promoters, cellular promoters are also amenable within the context of this invention. In particular, cellular promoters for the so-called housekeeping genes are useful. Viral promoters are preferred, because generally they are stronger promoters than cellular promoters. Promoter regions have been identified in the genes of many eukaryotes including higher eukaryotes, such that suitable promoters for use in a particular host can be readily selected by those skilled in the art.

Inducible promoters may also be used. These promoters include MMTV LTR (PCT WO 91/13160), inducible by dexamethasone; metallothionein promoter, inducible by heavy metals; and promoters with cAMP response elements, inducible by cAMP. By using an inducible promoter, the nucleic acid sequence encoding a binding domain-immunoglobulin fusion protein may be delivered to a cell by the subject invention expression construct and will remain quiescent until the addition of the inducer. This allows further control on the timing of production of the gene product.

Event-type specific promoters are active or up-regulated only upon the occurrence of an event, such as tumorigenicity or viral infection. The HIV LTR is a well known example of an event-specific promoter. The promoter is inactive unless the tat gene product is present, which occurs upon viral infection. Some event-type promoters are also tissue-specific.

Additionally, promoters that are coordinately regulated with a particular cellular gene may be used. For example, promoters of genes that are coordinately expressed may be used when expression of a particular binding domain-immunoglobulin fusion protein-encoding gene is desired in concert with expression of one or more additional endogenous or exogenously introduced genes. This type of promoter is especially useful when one knows the pattern of gene expression relevant to induction of an immune response in a particular tissue of the immune system, so that specific immunocompetent cells within that tissue may be activated or otherwise recruited to participate in the immune response.

In addition to the promoter, repressor sequences, negative regulators, or tissue-specific silencers may be inserted to reduce non-specific expression of binding domain-immunoglobulin fusion protein encoding genes in certain situations, such as, for example, a host that is transiently immunocompromised as part of a therapeutic strategy. Multiple repressor elements may be inserted in the promoter region. Repression of transcription is independent on the orientation of repressor elements or distance from the promoter. One type of repressor sequence is an insulator sequence. Such sequences inhibit transcription (Dunaway et al., *Mol Cell Biol* 17: 182-9, 1997; Gdula et al., *Proc Natl Acad Sci USA* 93:9378-83, 1996, Chan et al., *J Virol* 70: 5312-28, 1996; Scott and Geyer, *EMBO J* 14:6258-67, 1995; Kalos and Fournier, *Mol Cell Biol* 15:198-207, 1995; Chung et al., *Cell* 74: 505-14, 1993) and will silence background transcription.

Repressor elements have also been identified in the promoter regions of the genes for type II (cartilage) collagen, choline acetyltransferase, albumin (Hu et al., *J. Cell Growth Differ.* 3(9):577-588, 1992), phosphoglycerate kinase (PGK-2) (Misuno et al., *Gene* 119(2):293-297, 1992), and in the 6-phosphofructo-2-kinase/fructose-2,6-bisphosphatase gene. (Lemaigre et al., *Mol. Cell. Biol.* 11(2):1099-1106.) Furthermore, the negative regulatory element Tse-1 has been identified in a number of liver specific genes, and has been shown to block cAMP response element-(CRE) mediated induction of gene activation in hepatocytes. (Boshart et al., *Cell* 61(5):905-916, 1990).

In preferred embodiments, elements that increase the expression of the desired product are incorporated into the construct. Such elements include internal ribosome binding sites (IRES; Wang and Siddiqui, *Curr. Top. Microbiol. Immunol* 203:99, 1995; Ehrenfeld and Semler, *Curr. Top. Microbiol. Immunol.* 203:65, 1995; Rees et al., *Biotechniques* 20:102, 1996; Sugimoto et al., *Biotechnology* 12:694, 1994). IRES increase translation efficiency. As well, other sequences may enhance expression. For some genes, sequences especially at the 5' end inhibit transcription and/or translation. These sequences are usually palindromes that can form hairpin structures. Any such sequences in the nucleic acid to be delivered are generally deleted. Expression levels of the transcript or translated product are assayed to confirm or ascertain which sequences affect expression. Transcript levels may be assayed by any known method, including Northern blot hybridization, RNase probe protection and the like. Protein levels may be assayed by any known method, including ELISA, western blot, immunocytochemistry or other well known techniques.

Other elements may be incorporated into the binding domain-immunoglobulin fusion protein encoding constructs of the present invention. In preferred embodiments, the construct includes a transcription terminator sequence, including a polyadenylation sequence, splice donor and acceptor sites, and an enhancer. Other elements useful for expression and maintenance of the construct in mammalian cells or other eukaryotic cells may also be incorporated (e.g., origin of replication). Because the constructs are conveniently produced in bacterial cells, elements that are necessary for, or that enhance, propagation in bacteria are incorporated. Such elements include an origin of replication, a selectable marker and the like.

As provided herein, an additional level of controlling the expression of nucleic acids encoding binding domain-immunoglobulin fusion proteins delivered to cells using the constructs of the invention may be provided by simultaneously delivering two or more differentially regulated nucleic acid constructs. The use of such a multiple nucleic acid construct approach may permit coordinated regulation of an immune response such as, for example, spatiotemporal coordination that depends on the cell type and/or presence of another expressed encoded component. Those familiar with the art will appreciate that multiple levels of regulated gene expression may be achieved in a similar manner by selection of suitable regulatory sequences, including but not limited to promoters, enhancers and other well known gene regulatory elements.

The present invention also relates to vectors, and to constructs prepared from known vectors that include nucleic acids of the present invention, and in particular to "recombinant expression constructs" that include any nucleic acids encoding binding domain-immunoglobulin fusion proteins and polypeptides according to the invention as provided above; to host cells which are genetically engineered with vectors and/or constructs of the invention and to methods of administering expression constructs comprising nucleic acid sequences encoding such binding domain-immunoglobulin fusion polypeptides and fusion proteins of the invention, or fragments or variants thereof, by recombinant techniques. Binding domain-immunoglobulin fusion proteins can be expressed in virtually any host cell under the control of appropriate promoters, depending on the nature of the construct (e.g., type of promoter, as described above), and on the nature of the desired host cell (e.g., whether postmitotic terminally differentiated or actively dividing; e.g., whether the expression construct occurs in host cell as an episome or is integrated into host cell genome). Appropriate cloning and expression vectors for use with prokaryotic and eukaryotic hosts are described by Sambrook, et al., *Molecular Cloning: A Laboratory Manual*, Second Edition, Cold Spring Harbor, N.Y., (1989); as noted above, in particularly preferred embodiments of the invention, recombinant expression is conducted in mammalian cells that have been transfected or transformed with the subject invention recombinant expression construct.

Typically, the constructs are derived from plasmid vectors. A preferred construct is a modified pNASS vector (Clontech, Palo Alto, Calif.), which has nucleic acid sequences encoding an ampicillin resistance gene, a polyadenylation signal and a T7 promoter site. Other suitable mammalian expression vectors are well known (see, e.g., Ausubel et al., 1995; Sambrook et al., supra; see also, e.g., catalogues from Invitrogen, San Diego, Calif.; Novagen, Madison, Wis.; Pharmacia, Piscataway, N.J.; and others). Presently preferred constructs may be prepared that include a dihydrofolate reductase (DHFR) encoding sequence under suitable regulatory control, for promoting enhanced production levels of the binding domain-immunoglobulin fusion protein, which levels result from gene amplification following application of an appropriate selection agent (e.g., methetrexate).

Generally, recombinant expression vectors will include origins of replication and selectable markers permitting transformation of the host cell, and a promoter derived from a highly-expressed gene to direct transcription of a downstream structural sequence, as described above. The heterologous structural sequence is assembled in appropriate phase with translation initiation and termination sequences. Thus, for example, the binding domain-immunoglobulin fusion protein encoding nucleic acids as provided herein may be included in any one of a variety of expression vector constructs as a recombinant expression construct for expressing a binding domain-immunoglobulin fusion polypeptide in a host cell. In certain preferred embodiments the constructs are included in formulations that are administered in vivo. Such vectors and constructs include chromosomal, nonchromosomal and synthetic DNA sequences, e.g., derivatives of SV40; bacterial plasmids; phage DNA; yeast plasmids; vectors derived from combinations of plasmids and phage DNA, viral DNA, such as vaccinia, adenovirus, fowl pox virus, and pseudorabies, or replication deficient retroviruses as described below. However, any other vector may be used for preparation of a recombinant expression construct, and in preferred embodiments such a vector will be replicable and viable in the host.

The appropriate DNA sequence(s) may be inserted into the vector by a variety of procedures. In general, the DNA sequence is inserted into an appropriate restriction endonuclease site(s) by procedures known in the art. Standard techniques for cloning, DNA isolation, amplification and purification, for enzymatic reactions involving DNA ligase, DNA polymerase, restriction endonucleases and the like, and various separation techniques are those known and commonly employed by those skilled in the art. A number of standard techniques are described, for example, in Ausubel et al. (1993 *Current Protocols in Molecular Biology*, Greene Publ. Assoc. Inc. & John Wiley & Sons, Inc., Boston, Mass.); Sambrook et al. (1989 *Molecular Cloning*, Second Ed., Cold Spring Harbor Laboratory, Plainview, N.Y.); Maniatis et al. (1982 Molecular Cloning, Cold Spring Harbor Laboratory, Plainview, N.Y.); Glover (Ed.) (1985 *DNA Cloning Vol. I and II*, IRL Press, Oxford, UK); Hames and Higgins (Eds.), (1985 *Nucleic Acid Hybridization*, IRL Press, Oxford, UK); and elsewhere.

The DNA sequence in the expression vector is operatively linked to at least one appropriate expression control sequences (e.g., a constitutive promoter or a regulated promoter) to direct mRNA synthesis. Representative examples of such expression control sequences include promoters of eukaryotic cells or their viruses, as described above. Promoter regions can be selected from any desired gene using CAT (chloramphenicol transferase) vectors or other vectors with selectable markers. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art, and preparation of certain particularly preferred recombinant expression constructs comprising at least one promoter or regulated promoter operably linked to a nucleic acid encoding an binding domain-immunoglobulin fusion polypeptide is described herein.

Transcription of the DNA encoding the polypeptides of the present invention by higher eukaryotes may be increased by inserting an enhancer sequence into the vector. Enhancers are cis-acting elements of DNA, usually about from 10 to 300 by that act on a promoter to increase its transcription. Examples including the SV40 enhancer on the late side of the replication origin by 100 to 270, a cytomegalovirus early promoter enhancer, the polyoma enhancer on the late side of the replication origin, and adenovirus enhancers.

As provided herein, in certain embodiments the vector may be a viral vector such as a retroviral vector. (Miller et al., 1989 BioTechniques 7:980; Coffin and Varmus, 1996 Retroviruses, Cold Spring Harbor Laboratory Press, NY.) For example, retroviruses from which the retroviral plasmid vectors may be derived include, but are not limited to, Moloney Murine Leukemia Virus, spleen necrosis virus, retroviruses such as Rous Sarcoma Virus, Harvey Sarcoma virus, avian leukosis virus, gibbon ape leukemia virus, human immunodeficiency virus, adenovirus, Myeloproliferative Sarcoma Virus, and mammary tumor virus.

Retroviruses are RNA viruses which can replicate and integrate into the genome of a host cell via a DNA intermediate. This DNA intermediate, or provirus, may be stably integrated into the host cell DNA. According to certain embodiments of the present invention, an expression construct may comprise a retrovirus into which a foreign gene that encodes a foreign protein is incorporated in place of normal retroviral RNA. When retroviral RNA enters a host cell coincident with infection, the foreign gene is also introduced into the cell, and may then be integrated into host cell DNA as if it were part of the retroviral genome. Expression of this foreign gene within the host results in expression of the foreign protein.

Most retroviral vector systems which have been developed for gene therapy are based on murine retroviruses. Such retroviruses exist in two forms, as free viral particles referred to as virions, or as proviruses integrated into host cell DNA. The virion form of the virus contains the structural and enzymatic proteins of the retrovirus (including the enzyme reverse transcriptase), two RNA copies of the viral genome, and portions of the source cell plasma membrane containing viral envelope glycoprotein. The retroviral genome is organized into four main regions: the Long Terminal Repeat (LTR), which contains cis-acting elements necessary for the initiation and termination of transcription and is situated both 5' and 3' of the coding genes, and the three coding genes gag, pol, and env. These three genes gag, pol, and env encode, respectively, internal viral structures, enzymatic proteins (such as integrase), and the envelope glycoprotein (designated gp70 and p15e) which confers infectivity and host range specificity of the virus, as well as the "R" peptide of undetermined function.

Separate packaging cell lines and vector producing cell lines have been developed because of safety concerns regarding the uses of retroviruses, including their use in expression constructs as provided by the present invention. Briefly, this methodology employs the use of two components, a retroviral vector and a packaging cell line (PCL). The retroviral vector contains long terminal repeats (LTRs), the foreign DNA to be transferred and a packaging sequence (y). This retroviral vector will not reproduce by itself because the genes which encode structural and envelope proteins are not included within the vector genome. The PCL contains genes encoding the gag, pol, and env proteins, but does not contain the packaging signal "y". Thus, a PCL can only form empty virion particles by itself. Within this general method, the retroviral vector is introduced into the PCL, thereby creating a vector-producing cell line (VCL). This VCL manufactures virion particles containing only the retroviral vector's (foreign) genome, and therefore has previously been considered to be a safe retrovirus vector for therapeutic use.

"Retroviral vector construct" refers to an assembly which is, within preferred embodiments of the invention, capable of directing the expression of a sequence(s) or gene(s) of interest, such as binding domain-immunoglobulin fusion encoding nucleic acid sequences. Briefly, the retroviral vector construct must include a 5' LTR, a tRNA binding site, a packaging signal, an origin of second strand DNA synthesis and a 3' LTR. A wide variety of heterologous sequences may be included within the vector construct, including for example, sequences which encode a protein (e.g., cytotoxic protein, disease-associated antigen, immune accessory molecule, or replacement gene), or which are useful as a molecule itself (e.g., as a ribozyme or antisense sequence).

Retroviral vector constructs of the present invention may be readily constructed from a wide variety of retroviruses, including for example, B, C, and D type retroviruses as well as spumaviruses and lentiviruses (see, e.g., RNA Tumor Viruses, Second Edition, Cold Spring Harbor Laboratory, 1985). Such retroviruses may be readily obtained from depositories or collections such as the American Type Culture Collection ("ATCC"; Rockville, Md.), or isolated from known sources using commonly available techniques. Any of the above retroviruses may be readily utilized in order to assemble or construct retroviral vector constructs, packaging cells, or producer cells of the present invention given the disclosure provided herein, and standard recombinant techniques (e.g., Sambrook et al, Molecular Cloning: A Laboratory Manual, 2d ed., Cold Spring Harbor Laboratory Press, 1989; Kunkle, PNAS 82:488, 1985).

Suitable promoters for use in viral vectors generally may include, but are not limited to, the retroviral LTR; the SV40 promoter; and the human cytomegalovirus (CMV) promoter described in Miller, et al., Biotechniques 7:980-990 (1989), or any other promoter (e.g., cellular promoters such as eukaryotic cellular promoters including, but not limited to, the histone, pol III, and β-actin promoters). Other viral promoters which may be employed include, but are not limited to, adenovirus promoters, thymidine kinase (TK) promoters, and B19 parvovirus promoters. The selection of a suitable promoter will be apparent to those skilled in the art from the teachings contained herein, and may be from among either regulated promoters or promoters as described above.

As described above, the retroviral plasmid vector is employed to transduce packaging cell lines to form producer cell lines. Examples of packaging cells which may be transfected include, but are not limited to, the PE501, PA317, ψ-2, ψ-AM, PA12, T19-14X, VT-19-17-H2, ψCRE, ψCRIP, GP+E-86, GP+envAm12, and DAN cell lines as described in Miller, Human Gene Therapy, 1:5-14 (1990). The vector may transduce the packaging cells through any means known in the art. Such means include, but are not limited to, electroporation, the use of liposomes, and CaPO$_4$ precipitation. In one alternative, the retroviral plasmid vector may be encapsulated into a liposome, or coupled to a lipid, and then administered to a host.

The producer cell line generates infectious retroviral vector particles which include the nucleic acid sequence(s) encoding the binding domain-immunoglobulin fusion polypeptides or fusion proteins. Such retroviral vector particles then may be employed, to transduce eukaryotic cells, either in vitro or in vivo. The transduced eukaryotic cells will express the nucleic acid sequence(s) encoding the binding domain-immunoglobulin fusion polypeptide or fusion protein. Eukaryotic cells which may be transduced include, but are not limited to, embryonic stem cells, as well as hematopoietic stem cells, hepatocytes, fibroblasts, circulating peripheral blood mononuclear and polymorphonuclear cells including myelomonocytic cells, lymphocytes, myoblasts, tissue macrophages, dendritic cells, Kupffer cells, lymphoid and reticuloendothelia cells of the lymph nodes and spleen, keratinocytes, endothelial cells, and bronchial epithelial cells.

As another example of an embodiment of the ,invention in which a viral vector is used to prepare the recombinant binding domain-immunoglobulin fusion expression construct, in one preferred embodiment, host cells transduced by a recombinant viral construct directing the expression of binding domain-immunoglobulin fusion polypeptides or fusion proteins may produce viral particles containing expressed binding domain-immunoglobulin fusion polypeptides or fusion proteins that are derived from portions of a host cell membrane incorporated by the viral particles during viral budding.

In another aspect, the present invention relates to host cells containing the above described recombinant binding domain-immunoglobulin fusion expression constructs. Host cells are genetically engineered (transduced, transformed or transfected) with the vectors and/or expression constructs of this invention which may be, for example, a cloning vector, a shuttle vector or an expression construct. The vector or construct may be, for example, in the form of a plasmid, a viral particle, a phage, etc. The engineered host cells can be cultured in conventional nutrient media modified as appropriate for activating promoters, selecting transformants or amplifying particular genes such as genes encoding binding domain-immunoglobulin fusion polypeptides or binding domain-immunoglobulin fusion fusion proteins. The culture conditions for particular host cells selected for expression, such as temperature, pH and the like, will be readily apparent to the ordinarily skilled artisan.

The host cell can be a higher eukaryotic cell, such as a mammalian cell, or a lower eukaryotic cell, such as a yeast cell, or the host cell can be a prokaryotic cell, such as a bacterial cell. Representative examples of appropriate host cells according to the present invention include, but need not be limited to, bacterial cells, such as *E. coli, Streptomyces, Salmonella typhimurium*; fungal cells, such as yeast; insect cells, such as *Drosophila* S2 and *Spodoptera* Sf9; animal cells, such as CHO, COS or 293 cells; adenoviruses; plant cells, or any suitable cell already adapted to in vitro propagation or so established de novo. The selection of an appropriate host is deemed to be within the scope of those skilled in the art from the teachings herein.

Various mammalian cell culture systems can also be employed to express recombinant protein. Examples of mammalian expression systems include the COS-7 lines of monkey kidney fibroblasts, described by Gluzman, *Cell* 23:175 (1981), and other cell lines capable of expressing a compatible vector, for example, the C127, 3T3, CHO, HeLa and BHK cell lines. Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences, for example as described herein regarding the preparation of binding domain-immunoglobulin fusion expression constructs. DNA sequences derived from the SV40 splice, and polyadenylation sites may be used to provide the required nontranscribed genetic elements. Introduction of the construct into the host cell can be effected by a variety of methods with which those skilled in the art will be familiar, including but not limited to, for example, calcium phosphate transfection, DEAE-Dextran mediated transfection, or electroporation (Davis et al., 1986 *Basic Methods in Molecular Biology*).

The present invention binding domain-immunoglobulin fusion proteins, or compositions comprising one or more polynucleotides encoding same as described herein, (for example, to be administered under conditions and for a time sufficient to permit expression of a binding domain-immunoglobulin fusion protein in a host cell in vivo or in vitro), may be formulated into pharmaceutical compositions for administration according to well known methodologies. Pharmaceutical compositions generally comprise one or more recombinant expression constructs, and/or expression products of such constructs, in combination with a pharmaceutically acceptable carrier, excipient or diluent. Such carriers will be nontoxic to recipients at the dosages and concentrations employed. For nucleic acid-based formulations, or for formulations comprising expression products of the subject invention recombinant constructs, about 0.01 µg/kg to about 100 mg/kg body weight will be adminstered, typically by the intradermal, subcutaneous, intramuscular or intravenous route, or by other routes. A preferred dosage is about 1 µg/kg to about 1 mg/kg, with about 5 µg/kg to about 200 µg/kg particularly preferred. It will be evident to those skilled in the art that the number and frequency of administration will be dependent upon the response of the host. "Pharmaceutically acceptable carriers" for therapeutic use are well known in the pharmaceutical art, and are described, for example, in *Remingtons Pharmaceutical Sciences*, Mack Publishing Co. (A. R. Gennaro edit. 1985). For example, sterile saline and phosphate-buffered saline at physiological pH may be used. Preservatives, stabilizers, dyes and even flavoring agents may be provided in the pharmaceutical composition. For example, sodium benzoate, sorbic acid and esters of p-hydroxybenzoic acid may be added as preservatives. Id. at 1449. In addition, antioxidants and suspending agents may be used. Id.

"Pharmaceutically acceptable salt" refers to salts of the compounds of the present invention derived from the combination of such compounds and an organic or inorganic acid (acid addition salts) or an organic or inorganic base (base addition salts). The compounds of the present invention may be used in either the free base or salt forms, with both forms being considered as being within the scope of the present invention.

The pharmaceutical compositions that contain one or more binding domain-immunoglobulin fusion protein encoding constructs (or their expressed products) may be in any form which allows for the composition to be administered to a patient. For example, the composition may be in the form of a solid, liquid or gas (aerosol). Typical routes of administration include, without limitation, oral, topical, parenteral (e.g., sublingually or buccally), sublingual, rectal, vaginal, and intranasal. The term parenteral as used herein includes subcutaneous injections, intravenous, intramuscular, intrasternal, intracavernous, intrathecal, intrameatal, intraurethral injection or infusion techniques. The pharmaceutical composition is formulated so as to allow the active ingredients contained therein to be bioavailable upon administration of the composition to a patient. Compositions that will be administered to a patient take the form of one or more dosage units, where for example, a tablet may be a single dosage unit, and a container of one or more compounds of the invention in aerosol form may hold a plurality of dosage units.

For oral administration, an excipient and/or binder may be present. Examples are sucrose, kaolin, glycerin, starch dextrins, sodium alginate, carboxymethylcellulose and ethyl cellulose. Coloring and/or flavoring agents may be present. A coating shell may be employed.

The composition may be in the form of a liquid, e.g., an elixir, syrup, solution, emulsion or suspension. The liquid may be for oral administration or for delivery by injection, as two examples. When intended for oral administration, preferred compositions contain, in addition to one or more binding domain-immunoglobulin fusion construct or expressed product, one or more of a sweetening agent, preservatives, dye/colorant and flavor enhancer. In a composition intended to be administered by injection, one or more of a surfactant, preservative, wetting agent, dispersing agent, suspending agent, buffer, stabilizer and isotonic agent may be included.

A liquid pharmaceutical composition as used herein, whether in the form of a solution, suspension or other like form, may include one or more of the following adjuvants: sterile diluents such as water for injection, saline solution, preferably physiological saline, Ringer's solution, isotonic sodium chloride, fixed oils such as synthetic mono or digylcerides which may serve as the solvent or suspending medium, polyethylene glycols, glycerin, propylene glycol or other solvents; antibacterial agents such as benzyl alcohol or methyl paraben; antioxidants such as ascorbic acid or sodium bisulfate; chelating agents such as ethylenediaminetetraacetic acid; buffers such as acetates, citrates or phosphates and agents for the adjustment of tonicity such as sodium chloride or dextrose. The parenteral preparation can be enclosed in ampoules, disposable syringes or multiple dose vials made of glass or plastic. Physiological saline is a preferred adjuvant. An injectable pharmaceutical composition is preferably sterile.

It may also be desirable to include other components in the preparation, such as delivery vehicles including but not limited to aluminum salts, water-in-oil emulsions, biodegradable oil vehicles, oil-in-water emulsions, biodegradable microcapsules, and liposomes. Examples of immunostimulatory substances (adjuvants) for use in such vehicles include N-acetylmuramyl-L-alanine-D-isoglutamine (MDP), lipopoly-saccharides (LPS), glucan, IL-12, GM-CSF, gamma interferon and IL-15.

While any suitable carrier known to those of ordinary skill in the art may be employed in the pharmaceutical compositions of this invention, the type of carrier will vary depending on the mode of administration and whether a sustained release is desired. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactic galactide) may also be employed as carriers for the pharmaceutical compositions of this invention. Suitable biodegradable microspheres are disclosed, for example, in U.S. Pat. Nos. 4,897,268 and 5,075,109. In this regard, it is preferable that the microsphere be larger than approximately 25 microns.

Pharmaceutical compositions may also contain diluents such as buffers, antioxidants such as ascorbic acid, low molecular weight (less than about 10 residues) polypeptides, proteins, amino acids, carbohydrates including glucose, sucrose or dextrins, chelating agents such as EDTA, glutathione and other stabilizers and excipients. Neutral buffered saline or saline mixed with nonspecific serum albumin are exemplary appropriate diluents. Preferably, product is formulated as a lyophilizate using appropriate excipient solutions (e.g., sucrose) as diluents.

As described above, the subject invention includes compositions capable of delivering nucleic acid molecules encoding binding domain-immunoglobulin fusion proteins. Such compositions include recombinant viral vectors (e.g., retroviruses (see WO 90/07936, WO 91/02805, WO 93/25234, WO 93/25698, and WO 94/03622), adenovirus (see Berkner, *Biotechniques* 6:616-627, 1988; Li et al., *Hum. Gene Ther.* 4:403-409, 1993; Vincent et al., *Nat. Genet.* 5:130-134, 1993; and Kolls et al., *Proc. Natl. Acad. Sci. USA* 91:215-219, 1994), pox virus (see U.S. Pat. No. 4,769,330; U.S. Pat. No. 5,017,487; and WO 89/01973)), recombinant expression construct nucleic acid molecules complexed to a polycationic molecule (see WO 93/03709), and nucleic acids associated with liposomes (see Wang et al., *Proc. Natl. Acad. Sci. USA* 84:7851, 1987). In certain embodiments, the DNA may be linked to killed or inactivated adenovirus (see Curiel et al., *Hum. Gene Ther.* 3:147-154, 1992; Cotton et al., *Proc. Natl. Acad. Sci. USA* 89:6094, 1992). Other suitable compositions include DNA-ligand (see Wu et al., *J. Biol. Chem.* 264:16985-16987, 1989) and lipid-DNA combinations (see Felgner et al., *Proc. Natl. Acad. Sci. USA* 84:7413-7417, 1989).

In addition to direct in vivo procedures, ex vivo procedures may be used in which cells are removed from a host, modified, and placed into the same or another host animal. It will be evident that one can utilize any of the compositions noted above for introduction of binding domain-immunoglobulin fusion proteins or of binding domain-immunoglobulin fusion protein encoding nucleic acid molecules into tissue cells in an ex vivo context. Protocols for viral, physical and chemical methods of uptake are well known in the art.

Accordingly, the present invention is useful for treating a patient having a B-cell disorder or a malignant condition, or for treating a cell culture derived from such a patient. As used herein, the term "patient" refers to any warm-blooded animal, preferably a human. A patient may be afflicted with cancer or a malignant condition, such as B-cell lymphoma, or may be normal (i.e., free of detectable disease and infection). A "cell culture" includes any preparation amenable to ex vivo treatment, for example a preparation containing immunocompetent cells or isolated cells of the immune system (including, but not limited to, T cells, macrophages, monocytes, B cells and dendritic cells). Such cells may be isolated by any of a variety of techniques well known to those of ordinary skill in the art (e.g., Ficoll-hypaque density centrifugation). The cells may (but need not) have been isolated from a patient afflicted with a B-cell disorder or a malignant condition, and may be reintroduced into a patient after treatment.

A liquid composition intended for either parenteral or oral administration should contain an amount of binding domain-immunoglobulin fusion protein encoding construct or expressed product such that a suitable dosage will be obtained. Typically, this amount is at least 0.01 wt % of a binding domain-immunoglobulin fusion construct or expressed product in the composition. When intended for oral administration, this amount may be varied to be between 0.1 and about 70% of the weight of the composition. Preferred oral compositions contain between about 4% and about 50% of binding domain-immunoglobulin fusion construct or expressed product(s). Preferred compositions and preparations are prepared so that a parenteral dosage unit contains between 0.01 to 1% by weight of active compound.

The pharmaceutical composition may be intended for topical administration, in which case the carrier may suitably comprise a solution, emulsion, ointment or gel base. The base, for example, may comprise one or more of the following: petrolatum, lanolin, polyethylene glycols, beeswax, mineral oil, diluents such as water and alcohol, and emulsifiers and stabilizers. Thickening agents may be present in a pharmaceutical composition for topical administration. If intended for transdermal administration, the composition may include a transdermal patch or iontophoresis device. Topical formulations may contain a concentration of the binding domain-immunoglobulin fusion construct or expressed product of from about 0.1 to about 10% w/v (weight per unit volume).

The composition may be intended for rectal administration, in the form, e.g., of a suppository which will melt in the rectum and release the drug. The composition for rectal administration may contain an oleaginous base as a suitable nonirritating excipient. Such bases include, without limitation, lanolin, cocoa butter and polyethylene glycol.

In the methods of the invention, the binding domain-immunoglobulin fusion encoding constructs or expressed product(s) may be administered through use of insert(s), bead(s), timed-release formulation(s), patch(es) or fast-release formulation(s).

The following Examples are offered by way of illustration and not by way of limitation.

EXAMPLES

Example 1

Cloning of the 2H7 Variable Regions and Construction and Sequencing of 2H7scFv-Ig This Example illustrates the cloning of cDNA molecules that encode the heavy chain and light chain variable regions of the monoclonal antibody 2H7. This Example also demonstrates the construction, sequencing, and expression of 2H7scFv-Ig.

Hybridoma cells expressing 2H7 monoclonal antibody that specifically bound to CD20 were provided by Ed Clark at the University of Washington, Seattle, Wash. Prior to harvesting, hybridoma cells were kept in log phase growth for several days in RPMI 1640 media Invitrogen/Life Technologies, Gaithersburg, Md.) supplemented with glutamine, pyruvate, DMEM non-essential amino acids, and penicillin-streptomycin. Cells were pelleted by centrifugation from the culture medium, and $2 \times 10^7$ cells were used to prepare RNA. RNA was isolated from the 2H7-producing hybridoma cells using the Pharmingen (San Diego, Calif.) total RNA isolation kit (Catalog #45520K) according to the manufacturer's instructions accompanying the kit. One microgram (1 µg) of total RNA was used as template to prepare cDNA by reverse transcription. The RNA and 300 ng random primers were combined and denatured at 72° C. for 10 minutes prior to addition of enzyme. Superscript II reverse transcriptase (Life Technologies) was added to the RNA plus primer mixture in a total volume of 25 µl in the presence of 5× second strand buffer and 0.1 M DTT provided with the enzyme. The reverse transcription reaction was allowed to proceed at 42° C. for one hour.

The 2H7 cDNA generated in the randomly primed reverse transcriptase reaction and V region specific primers were used to amplify by PCR the variable regions for the light and heavy chain of the 2H7 antibody. The V region specific primers were designed using the published sequence (Genbank accession numbers M17954 for $V_L$ and M17953 for $V_H$) as a guide. The two variable chains were designed with compatible end sequences so that an scFv could be assembled by ligation of the two V regions after amplification and restriction enzyme digestion.

A (gly$_4$ser)$_3$ peptide linker to be inserted between the two V regions was incorporated by adding the extra nucleotides to the antisense primer for the $V_L$ of 2H7. A Sac I restriction site was also introduced at the junction between the two V regions. The sense primer used to amplify the 2H7 $V_L$, that included a HindIII restriction site and the light chain leader peptide was 5'-gtc aagctt gcc gcc atg gat ttt caa gtg cag att ttt cag c-3' (SEQ ID NO: 21). The antisense primer was 5'-gtc gtc gag ctc cca cct cct cca gat cca cca ccg ccc gag cca ccg cca cct ttc agc tcc agc ttg gtc cc-3' (SEQ ID NO: 24). The reading frame of the V region is indicated as a bold, underlined codon. The Hind III and SacI sites are indicated by underlined italicized sequences.

The $V_H$ domain was amplified without a leader peptide, but included a 5' SacI restriction site for fusion to the $V_L$ and a BclI restriction site at the 3' end for fusion to various tails, including the human IgG1 Fc domain and the truncated forms of CD40 ligand, CD154. The sense primer was 5'-gct gct gagctc tca ggc tta tct aca gca agt ctg g-3' (SEQ ID NO: 25). The SacI site is indicated in italicized and underlined font, and the reading frame of the codon for the first amino acid of the $V_H$ domain is indicated in bold, underlined type. The antisense primer was 5'-gtt gtc tgatca gag acg gtg acc gtg gtc cc-3' (SEQ ID NO: 26). The BclI site is indicated in italicized, underlined type, and the last serine of the $V_H$ domain sequence is indicated in bold, underlined type.

The scFv-Ig was assembled by inserting the 2H7 scFv HindIII-BclI fragment into pUC 19 containing the human IgG1 hinge, CH2, and CH3 regions, which was digested with restriction enzymes, HindIII and BclI. After ligation, the ligation products were transformed into DH5α bacteria. Positive clones were screened for the properly inserted fragments using the SacI site at the $V_L$-$V_H$ junction of 2H7 as a diagnostic site. The 2H7scFv-Ig cDNA was subjected to cycle sequencing on a PE9700 thermocycler using a 25-cycle program by denaturing at 96° C. for 10 seconds, annealing 50° C. for 30 seconds, and extending at 72° C. for 4 minutes. The sequencing primers were pUC forward and reverse primers and an internal primer that annealed to the CH2 domain human in the IgG constant region portion. Sequencing reactions were performed using the BIG DYE™ Terminator Ready Sequencing Mix (PE-Applied Biosystems, Foster City, Calif.) according to the manufacturer's instructions. Samples were subsequently purified using CENTRISEP columns (Catalog #CS-901, Princeton Separations, Adelphia, N.J.), the eluates dried in a Savant vacuum dryer, denatured in Template Suppression on Reagent (PE-ABI), and analyzed on an ABI 310 Genetic Analyzer (PE-Applied Biosystems). The sequence was edited, translated, and analyzed using Vector NTI™ version 6.0 (Informax, North Bethesda, Md.). FIG. 1 shows the cDNA and predicted amino acid sequence of the 2H7scFv-Ig construct.

Example 2

Expression of 2H7 ScFv-Ig in Stable CHO Cell Lines

This Example illustrates expression of 2H7scFv-Ig in a eukaryotic cell line and characterization of the expressed 2H7scFv-Ig by SDS-PAGE and by functional assays, including ADCC and complement fixation.

The 2H7scFv-Ig HindIII-XbaI (~1.6 kb) fragment with correct sequence was inserted into the mammalian expression vector pD18, and DNA from positive clones was amplified using QIAGEN plasmid preparation kits (QIAGEN, Valencia, Calif.). The recombinant plasmid DNA (100 μg) was then linearized in a nonessential region by digestion with AscI, purified by phenol extraction, and resuspended in tissue culture media, Excell 302 (Catalog #14312-79P, JRH Biosciences, Lenexa, Kans.). Cells for transfection, CHO DG44 cells, were kept in logarithmic growth, and $10^7$ cells harvested for each transfection reaction. Linearized DNA was added to the CHO cells in a total volume of 0.8 ml for electroporation.

Stable production of the 2H7 scFv-Ig fusion protein (SEQ. ID NO:10) was achieved by electroporation of a selectable, amplifiable plasmid, pD18, containing the 2H7 scFv-Ig cDNA under the control of the CMV promoter, into Chinese Hamster Ovary (CHO) cells (all cell lines from American Type Culture Collection, Manassas, Va., unless otherwise noted). The 2H7 expression cassette was subcloned downstream of the CMV promoter into the vector multiple cloning site as a ~1.6 kb HindIII-XbaI fragment. The pD18 vector is a modified version of pcDNA3 encoding the DHFR selectable marker with an attenuated promoter to increase selection pressure for the plasmid. Plasmid DNA was prepared using Qiagen maxiprep kits, and purified plasmid was linearized at a unique AscI site prior to phenol extraction and ethanol precipitation. Salmon sperm DNA (Sigma-Aldrich, St. Louis, Mo.) was added as carrier DNA, and 100 μg each of plasmid and carrier DNA was used to transfect $10^7$ CHO DG44 cells by electroporation. Cells were grown to logarithmic phase in Excell 302 media (JRH Biosciences) containing glutamine (4 mM), pyruvate, recombinant insulin, penicillin-streptomycin, and 2×DMEM nonessential amino acids (all from Life Technologies, Gaithersburg, Md.), hereafter referred to as "Excell 302 complete" media. Media for untransfected cells also contained HT (diluted from a 100× solution of hypoxanthine and thymidine) (Invitrogen/Life Technologies). Media for transfections under selection contained varying levels of methotrexate (Sigma-Aldrich) as selective agent, ranging from 50 nM to 5 μM. Electroporations were performed at 275 volts, 950 μF. Transfected cells were allowed to recover overnight in non-selective media prior to selective plating in 96 well flat bottom plates (Costar) at varying serial dilutions ranging from 125 cells/well to 2000 cells/well. Culture media for cell cloning was Excell 302 complete, containing 100 nM methotrexate. Once clonal outgrowth was sufficient, serial dilutions of culture supernatants from master wells were screened for binding to CD20-CHO transfected cells. The clones with the highest production of the fusion protein were expanded into T25 and then T75 flasks to provide adequate numbers of cells for freezing and for scaling up production of the 2H7scFvIg. Production levels were further increased in cultures from three clones by progressive amplification in methotrexate containing culture media. At each successive passage of cells, the Excell 302 complete media contained an increased concentration of methotrexate, such that only the cells that amplified the DHFR plasmid could survive.

Supernatants were collected from CHO cells expressing the 2H7scFv-Ig, filtered through 0.2 μm PES express filters (Nalgene, Rochester, N.Y.) and were passed over a Protein A-agarose (IPA 300 crosslinked agarose) column (Repligen, Needham, Mass.). The column was washed with PBS, and then bound protein was eluted using 0.1 M citrate buffer, pH 3.0. Fractions were collected and eluted protein was neutralized using 1M Tris, pH 8.0, prior to dialysis overnight in PBS. Concentration of the purified 2H7scFv-Ig (SEQ ID NO:15) was determined by absorption at 280 nm. An extinction coefficient of 1.77 was determined using the protein analysis tools in the Vector NTI™ Version 6.0 Software package (Informax, North Bethesda, Md.). This program uses the amino acid composition data to calculate extinction coefficients.

Production levels of 2H7scFv-Ig by transfected, stable CHO cells were analyzed by flow cytometry. Purified 2H7scFv-Ig to CHO cells was allowed to bind to CHO cells that expressed CD20 (CD20 CHO) and analyzed by flow cytometry using a fluorescein-conjugated anti-human IgG second step reagent (Catalog Numbers H10101 and H10501, CalTag, Burlingame, Calif.). FIG. 2 (top) shows a standard curve generated by titration of 2H7scFv-Ig binding to CD20 CHO. At each concentration of 2H7scFv-Ig, the mean brightness of the fluorescein signal in linear units is shown. Supernatants collected from T flasks containing stable CHO cell clones expressing 2H7scFv-Ig were then allowed to bind to CD20 CHO and the binding was analyzed by flow cytometry. The fluorescein signal generated by 2H7scFv-Ig contained in the supernatants was measured and the 2H7scFv-Ig concentration in the supernatants was calculated from the standard curve (FIG. 2, bottom).

Figure 3:
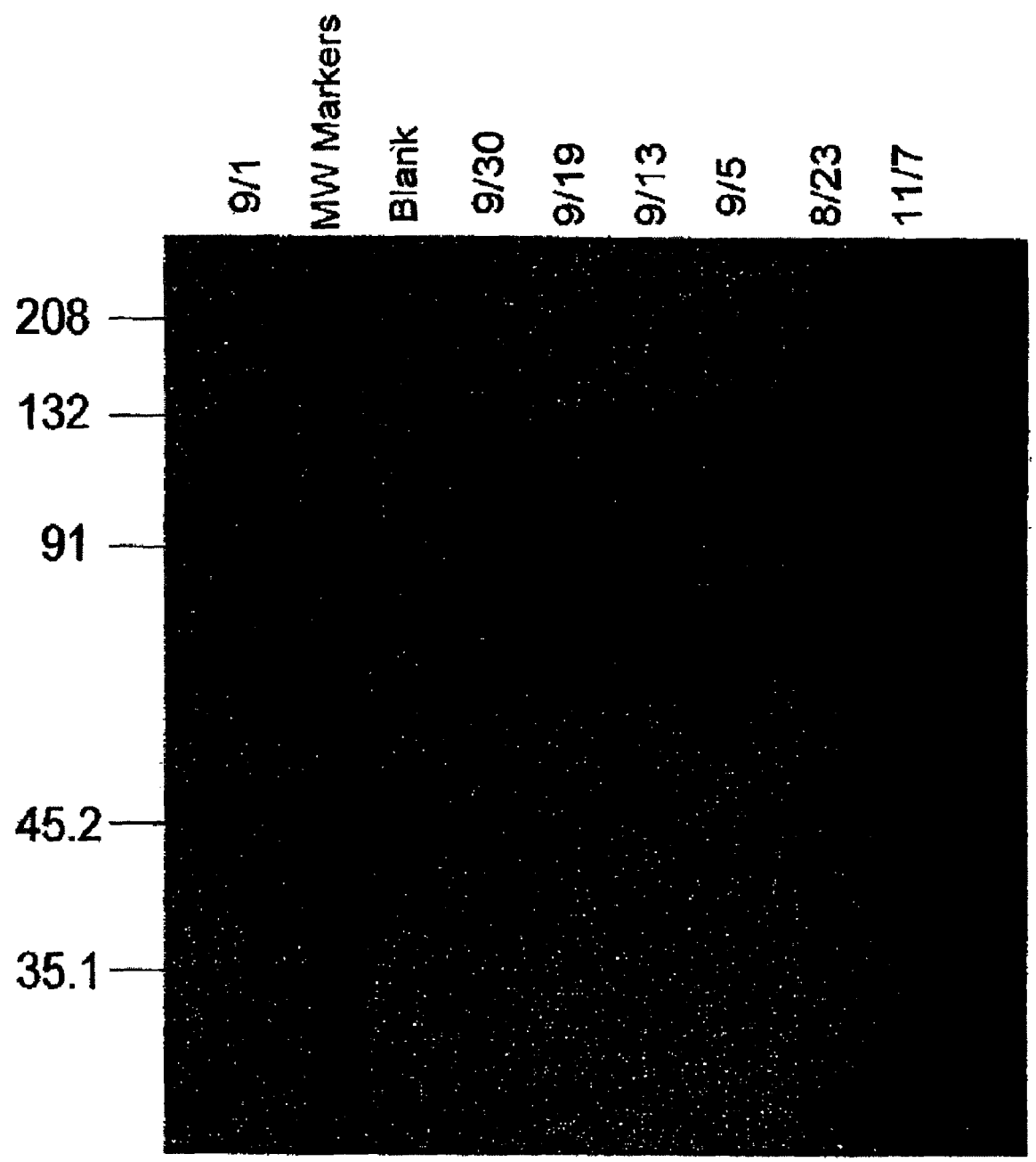
FIG. 3 shows SDS-PAGE analysis of multiple preparations of isolated 2H7scFv-Ig protein.

Purified 2H7scFv-Ig (SEQ ID NOs: 1 and 11) was analyzed by electrophoresis on SDS-Polyacrylamide gels. Samples of 2H7scFv-Ig, purified by independent Protein A Agarose column runs, were boiled in SDS sample buffer without reduction of disulfide bonds and applied to SDS 10% Tris-BIS gels (Catalog #NP0301, Novex, Carlsbad, Calif.). Twenty micrograms of each purified batch was loaded on the gels. The proteins were visualized after electrophoresis by Coomassie Blue staining (Pierce Gel Code Blue Stain Reagent, Catalog #24590, Pierce, Rockford, Ill.), and destaining in distilled water. Molecular weight markers were included on the same gel (Kaleidoscope Prestained Standards, Catalog #161-0324, Bio-Rad, Hercules, Calif.). The results are presented in FIG. 3. The numbers above the lanes designate independent purification batches. The molecular weights in kilodaltons of the size markers are indicated on the left side of the figure. Further experiments with alternative sample preparation conditions indicated that reduction of disulfide bonds by boiling the protein in SDS sample buffer containing DTT or 2-mercaptoethanol caused the 2H7scFv-Ig to aggregate.

Any number of other immunological parameters may be monitored using routine assays that are well known in the art. These may include, for example, antibody dependent cell-mediated cytotoxicity (ADCC) assays, secondary in vitro antibody responses, flow immunocytofluorimetric analysis of various peripheral blood or lymphoid mononuclear cell subpopulations using well established marker antigen systems, immunohistochemistry or other relevant assays. These and other assays may be found, for example, in Rose et al. (Eds.), *Manual of Clinical Laboratory Immunology, 5th Ed.,* 1997 American Society of Microbiology, Washington, D.C.

The ability of 2H7scFv-Ig to kill CD20 positive cells in the presence of complement was tested using B cell lines Ramos and Bjab. Rabbit complement (Pel-Freez, Rogers, Ak.) was used in the assay at a final dilution of 1/10. Purified 2H7scFv-Ig was incubated with B cells and complement for 45 minutes at 37° C., followed by counting of live and dead cells by trypan blue exclusion. The results in FIG. 4A show that in the presence of rabbit complement, 2H7scFv-Ig lysed B cells expressing CD20.

The ability of 2H7scFv-Ig to kill CD20 positive cells in the presence of peripheral blood mononuclear cells (PBMC) was tested by measuring the release of $^{51}$Cr from labeled Bjab cells in a 4-hour assay using a 100:1 ratio of PBMC to Bjab cells. The results shown in FIG. 4B indicated that 2H7scFv-Ig can mediate antibody dependent cellular cytotoxicity (ADCC) because the release of $^{51}$Cr was higher in the presence of both PBMC and 2H7scFv-Ig than in the presence of either PBMC or 2H7scFv-Ig alone.

Example 3

Effect of Simultaneous Ligation of CD20 and CD40 on Growth of Normal B Cells, and on CD95 Expression, and Induction of Apoptosis This example illustrates the effect of cross-linking of CD20 and CD40 expressed on the cell surface on cell proliferation.

Figure 5:
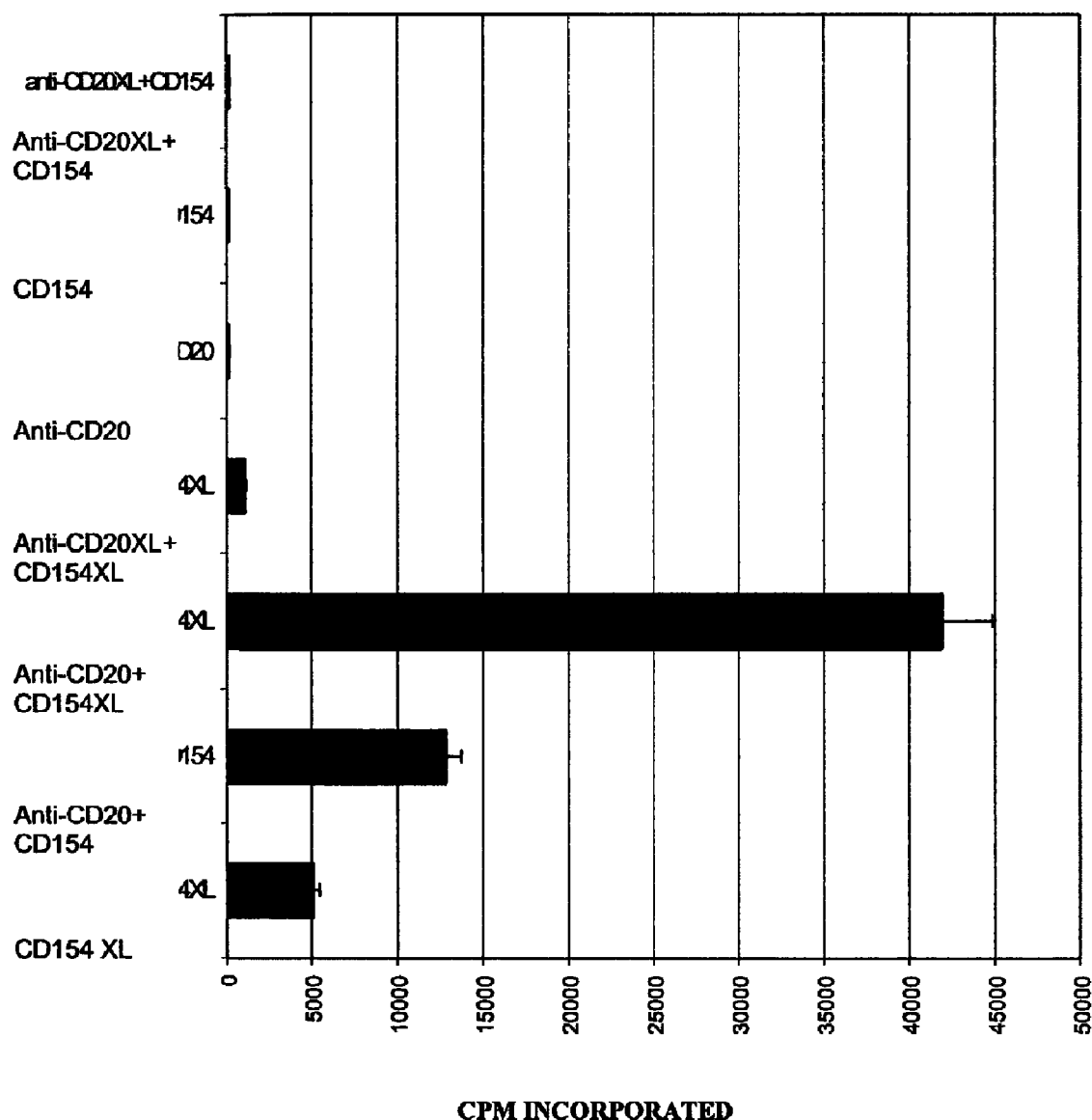
FIG. 5 shows the effect of simultaneous ligation of CD20 and CD40 on growth of normal B cells.

Dense resting B cells were isolated from human tonsil by a Percoll step gradient and T cells were removed by E-rosetting. Proliferation of resting, dense tonsillar B cells was measured by uptake of $^3$[H]-thymidine during the last 12 hours of a 4-day experiment. Proliferation was measured in quadruplicate cultures with means and standard deviations as shown. Murine anti-human CD20 mAb 1F5 (anti-CD20) was used alone or was cross-linked with anti-murine κ mAb 187.1 (anti-CD20 XL). CD40 activation was accomplished using soluble human CD154 fused with murine CD8 (CD154) (Hollenbaugh et al., *EMBO J.* 11: 4212-21 (1992)), and CD40 cross-linking was accomplished using anti-murine CD8 mAb 53-6 (CD154XL). This procedure allowed simultaneous cross-linking of CD20 and CD40 on the cell surface. The results are presented in FIG. 5.

The effect of CD20 and CD40 cross-linking on Ramos cells, a B lymphoma cell line, was examined. Ramos cells were analyzed for CD95 (Fas) expression and percent apoptosis eighteen hours after treatment (no goat anti-mouse IgG (GAM)) and/or cross-linking (+GAM) using murine mAbs that specifically bind CD20 (1F5) and CD40 (G28-5). Control cells were treated with a non-binding isotype control (64.1) specific for CD3.

Figure 6A:
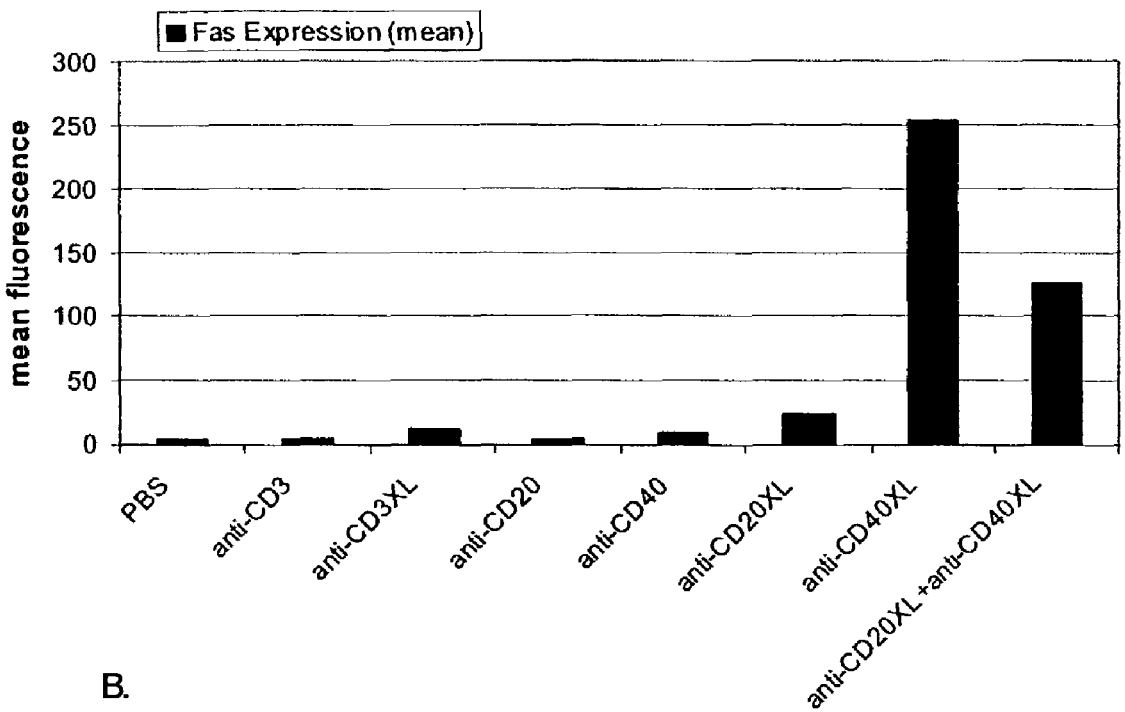
FIG. 6 shows the effect of simultaneous ligation of CD20 and CD40 on CD95 expression and induction of apoptosis in a B lymphoblastoid cell line.

Treated Ramos cells were harvested, incubated with FITC-anti-CD95, and analyzed by flow cytometry to determine the relative expression level of Fas on the cell surface after CD20 or CD40 cross-linking. Data is plotted as mean fluorescence of cells after treatment with the stimuli indicated (FIG. 6A).

Figure 6B:
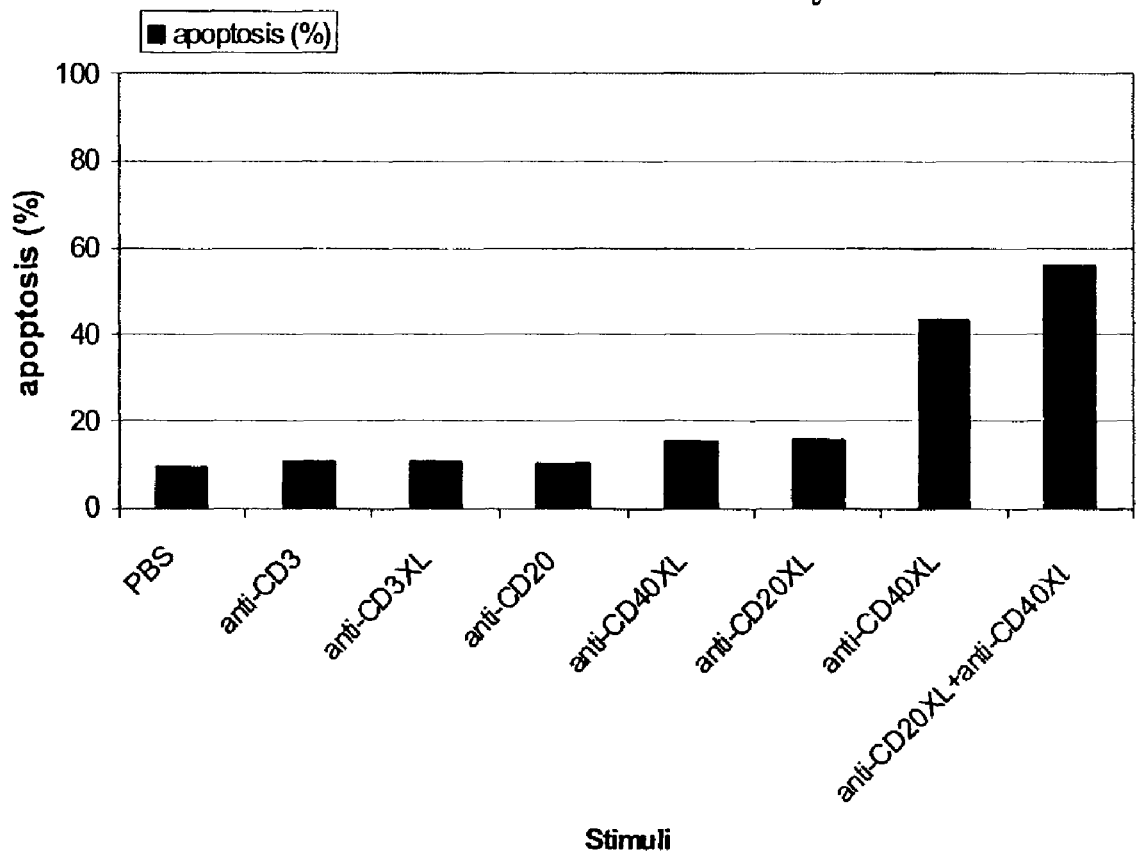

Treated Ramos cells from the same experiment were harvested and binding of annexin V was measured to indicate the percentage apoptosis in the treated cultures. Apoptosis was measured by binding of Annexin V 18 hours after cross-linking of CD20 and CD40 using 1F5 and G28-5 followed by cross-linking with GAM. Binding of Annexin V was measured using a FITC-Annexin V kit (Catalog #PN-1M2376, Immunotech, Marseille, France,). Annexin V binding is known to be an early event in progression of cells into apoptosis. Apoptosis, or programmed cell death, is a process characterized by a cascade of catabolic reactions leading to cell death by suicide. In the early phase of apoptosis, before cells change morphology and hydrolyze DNA, the integrity of the cell membrane is maintained but cells lose the asymmetry of their membrane phospholipids, exposing negatively charged phospholipids, such as phosphatidylserine, at the cell surface. Annexin V, a calcium and phospholipid binding protein, binds preferentially and with high affinity to phosphatidylserine. Results demonstrating the effect of cross-linking both CD20 and CD40 on expression of the FAS receptor (CD95) are presented in FIG. 6B. The effect of cross-linking of both CD20 and CD40 on Annexin V binding to cells is shown in FIG. 6B.

Example 4

Construction and Characterization of 2H7 ScFv-CD154 Fusion Proteins

To construct a molecule capable of binding to both CD20 and CD40, cDNA encoding the 2H7 scFv was fused with cDNA encoding CD154, the CD40 ligand. The 2H7 scFv cDNA encoded on the HindIII-BclI fragment was removed from the 2H7 scFvIg construct, and inserted into a pD18 vector along with a BamHI-XbaI cDNA fragment encoding the extracellular domain of human CD154. The extracellular domain is encoded at the carboxy terminus of CD154, similar to other type II membrane proteins.

The extracellular domain of human CD154 was PCR amplified using cDNA generated with random primers and RNA from human T lymphocytes activated with PHA (phytohemagglutinin). The primer sets included two different 5' or sense primers that created fusion junctions at two different positions within the extracellular domain of CD154. Two different fusion junctions were designed that resulted in a short or truncated form (form S4) including amino acids 108 (Glu)–261 (Leu)+(Glu), and a long or complete form (form L2) including amino acids 48 (Arg)–261 (Leu)+(Glu), of the extracellular domain of CD154, both constructed as BamHI-XbaI fragments. The sense primer which fuses the two different truncated extracellular domains to the 2H7scFv includes a BamHI site for cloning. The sense primer for the S4 form of the CD154 cDNA is designated CD154BAM108 and encodes a 34 mer with the following sequence: 5'-gtt gtc gga tcc aga aaa cag ctt tga aat gca a-3' (SEQ ID NO: 27), while the antisense primer is designated CD154XBA and encodes a 44 mer with the following sequence: 5'-gtt gtt tct aga tta tca ctc gag ttt gag taa gcc aaa gga cg-3' (SEQ ID NO: 28).

The oligonucleotide primers used in amplifying the long form (L2) of the CD154 extracellular domain encoding amino acids 48 (Arg)–261 (Leu)+(Glu), were as follows: The sense primer designated CD154 BAM48 encoded a 35-mer with the following sequence: 5'-gtt gtc gga tcc aag aag gtt gga caa gat aga ag-3'(SEQ ID NO: 29). The antisense primer designated CD154XBA encoded the 44-mer: 5'-gtt gtt tct aga tta tca ctc gag ttt gag taa gcc aaa gga cg-3' (SEQ ID NO: 28). Other PCR reaction conditions were identical to those used for amplifying the 2H7 scFv (see Example 1). PCR fragments were purified by PCR quick kits (QIAGEN, San Diego, Calif.), eluted in 30 μl ddH$_2$O, and digested with BamHI and XbaI (Roche) restriction endonucleases in a 40 μl reaction volume at 37° C. for 3 hours. Fragments were gel purified, purified using QIAEX kits according to the manufacturer's instructions (QIAGEN), and ligated along with the 2H7 HindIII-BclI fragment into the pD18 expression vector digested with HindIII+XbaI. Ligation reactions were transformed into DH5-alpha chemically competent bacteria and plated onto LB plates containing 100 μg/ml ampicillin. Transformants were grown overnight at 37° C., and isolated colonies used to inoculate 3 ml liquid cultures in Luria Broth containing 100 µg/ml ampicillin. Clones were screened after mini-plasmid preparations (QIAGEN) for insertion of both the 2H7 scFv and the CD154 extracellular domain fragments.

The 2H7scFv-CD154 construct cDNAs were subjected to cycle sequencing on a PE 9700 thermocycler using a 25-cycle program that included denaturating at 96° C., 10 seconds, annealing at 50° C. for 5 seconds, and extension at 60° C., for 4 minutes. The sequencing primers used were pD18 forward (SEQ ID NO: 30: 5'-gtctatataagcagagctctggc-3') and pD18 reverse (SEQ ID NO: 31: 5'-cgaggctgatcagcgagctctagca-3') primers. In addition, an internal primer was used that had homology to the human CD154 sequence (SEQ ID NO: 32: 5'-ccgcaatttgaggattctgatcacc-3'). Sequencing reactions included primers at 3.2 pmol, approximately 200 ng DNA template, and 8 µl sequencing mix. Sequencing reactions were performed using the BIG DYE™ Terminator Ready Sequencing Mix (PE-Applied Biosystems, Foster City, Calif.) according to the manufacturer's instructions. Samples were subsequently purified using CENTRISEP columns (Princeton Separations, Adelphia, N.J.). The eluates were dried in a Savant speed-vacuum dryer, denatured in 20 µl template Suppression Reagent (ABI) at 95° C. for 2 minutes, and analyzed on an ABI 310 Genetic Analyzer (PE-Applied Biosystems). The sequence was edited, translated, and analyzed using Vector NTI™ version 6.0 (Informax, North Bethesda, Md.). The 2H7scFv-CD154 L2 cDNA sequence and predicted amino acid sequence is presented in FIG. 7A, and 2H7scFv-CD154 S4 cDNA sequence and predicted amino acid sequence is presented in FIG. 7B.

Figure 8:
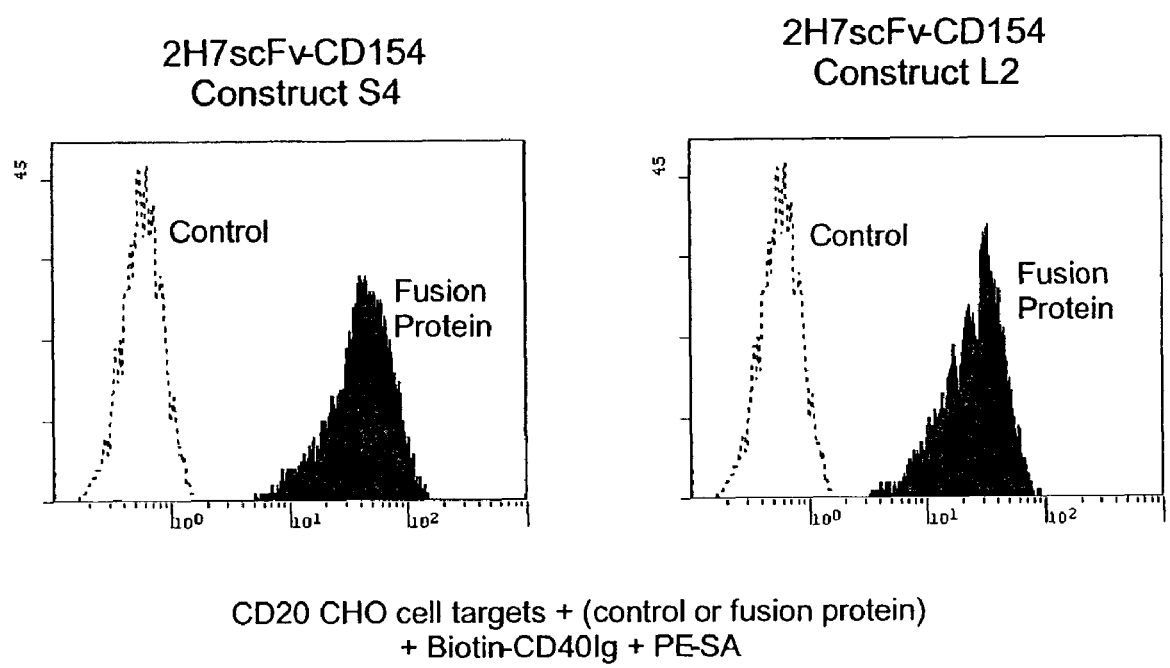
FIG. 8 shows binding of 2H7scFv-CD154 binding domain-immunoglobulin fusion proteins to CD20+ CHO cells by flow immunocytofluorimetry.

The binding activity of the 2H7 scFv-CD154 fusion proteins (SEQ ID NOS: 33, 150 and 34, 152) to CD20 and CD40 simultaneously was determined by flow cytometry. The assay used CHO cell targets that express CD20. After a 45-minute incubation of CD20 CHO cells with supernatants from cells transfected with the 2H7 scFv-CD154 expression plasmid, the CD20 CHO cells were washed twice and incubated with biotin-conjugated CD40-Ig fusion protein in PBS/2% FBS. After 45 min, cells were washed twice and incubated with phycoerythrin (PE)-labeled strepavidin at 1:100 in PBS/2% FBS (Molecular Probes, Eugene Oreg.). After an additional 30 min incubation, cells were washed 2× and were analyzed by flow cytometry. The results show that the 2H7 scFv-CD154 molecule was able to bind to CD20 on the cell surface and to capture biotin-conjugated CD40 from solution (FIG. 8).

Figure 9:
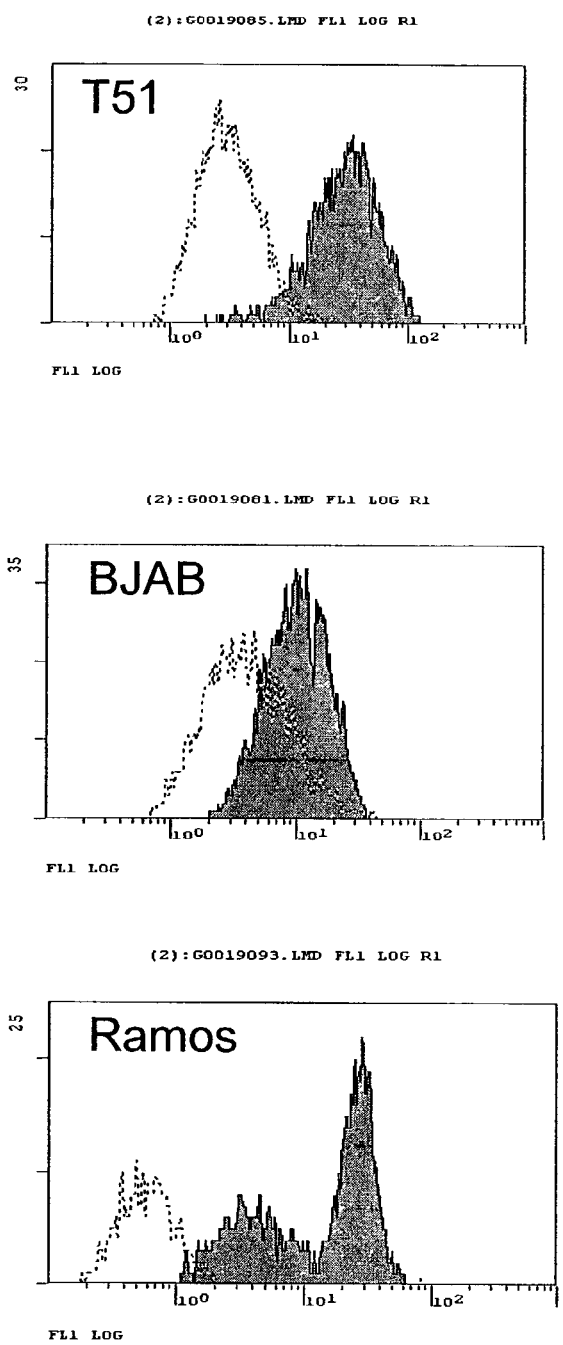
FIG. 9 shows binding of Annexin V to B cell lines Ramos, BJAB, and T51 after binding of 2H7scFv-CD154 binding domain-immunoglobulin fusion protein to cells.

To determine the effect of the 2H7scFv-CD154 on growth and viability of B lymphoma and lymphoblastoid cell lines, cells were incubated with 2H7scFv-CD154 L2 (SEQ. ID NO: 33, 150) for 12 hours and then examined for binding of Annexin V. Binding of Annexin V was measured using a FITC-Annexin V kit (Immunotech, Marseille, France, Catalog #PN-IM2376). B cell lines were incubated in 1 ml cultures with dilutions of concentrated, dialyzed supernatants from cells expressing secreted forms of the 2H7scFv-CD154 fusion proteins. The results are presented in FIG. 9.

Figure 10:
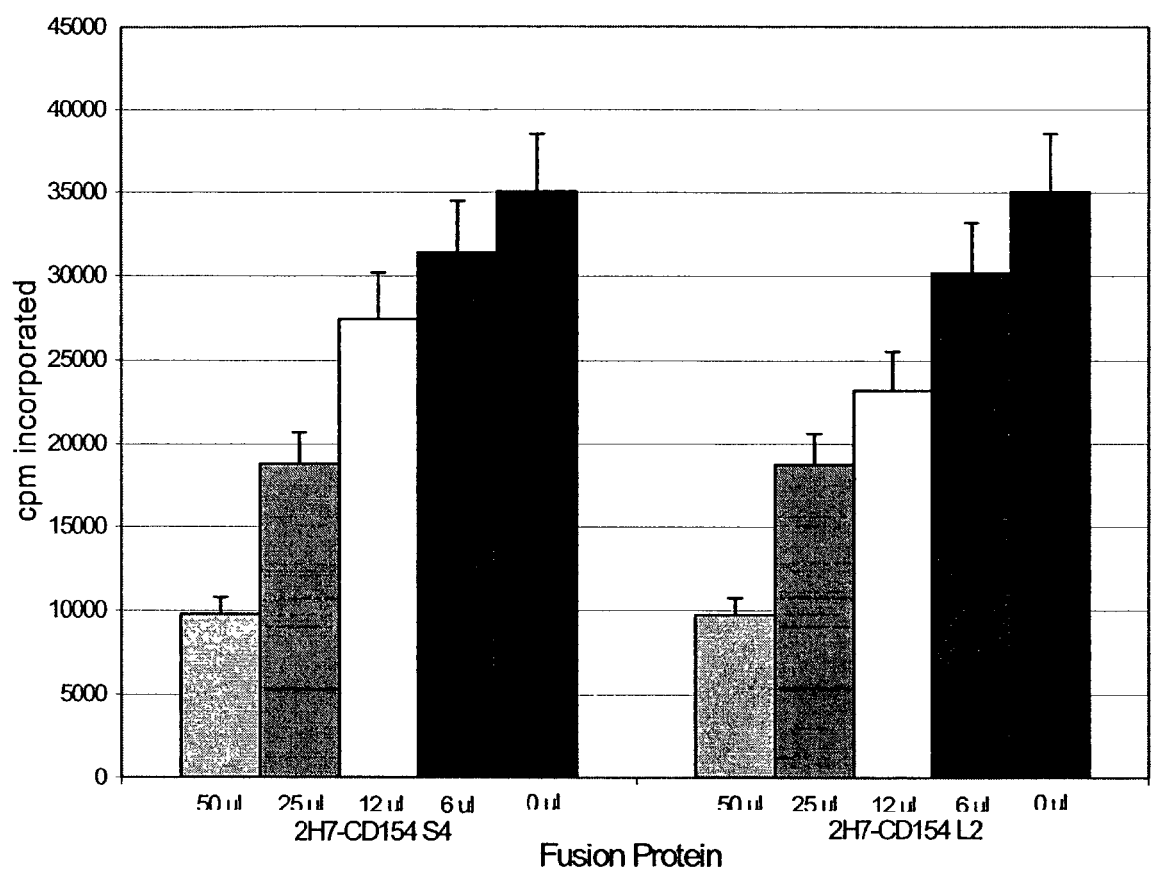
FIG. 10 shows effects on proliferation of B cell line T51 following binding of 2H7scFv-CD154 binding domain-immunoglobulin fusion protein.

The growth rate of the Ramos B lymphoma cell line in the presence of 2H7scFv-CD154 was examined by uptake of $^3$H-thymidine for the last 6 hours of a 24-hour culture. The effect of 2H7scFv-CD154 on cell proliferation is shown in FIG. 10.

Example 5

Construction and Characterization of CytoxB Antibody Derivatives

CytoxB antibodies were derived from the 2H7 scFv-IgG polypeptide. The 2H7 scFv (see Example 1) was linked to the human IgG1 Fc domain via an altered hinge domain (see FIG. 11). Cysteine residues in the hinge region were substituted with serine residues by site-directed mutagenesis and other methods known in the art. The mutant hinge was fused either to a wild-type Fc domain to create one construct, designated CytoxB-MHWTG1C, or was fused to a mutated Fc domain (CytoxB-MHMG1C) that had additional mutations introduced into the CH2 domain. Amino acid residues in CH2 that are implicated in effector function are illustrated in FIG. 11. Mutations of one or more of these residues may reduce FcR binding and mediation of effector functions. In this example, the leucine residue 234 known in the art to be important to Fc receptor binding, was mutated in the 2H7 scFv fusion protein, CytoxB-[MG1H/MG1C]. In another construct, the human IgG1 hinge region was substituted with a portion of the human IgA hinge, which was fused to wild-type human Fc domain (CytoxB-IgAHWTHG1C). (See FIG. 11). This mutated hinge region allows expression of a mixture of monomeric and dimeric molecules that retain functional properties of the human IgG1 CH2 and CH3 domains. Synthetic, recombinant cDNA expression cassettes for these molecules were constructed and polypeptides were expressed in CHODG44 cells according to methods described in Example 2.

Figure 12:
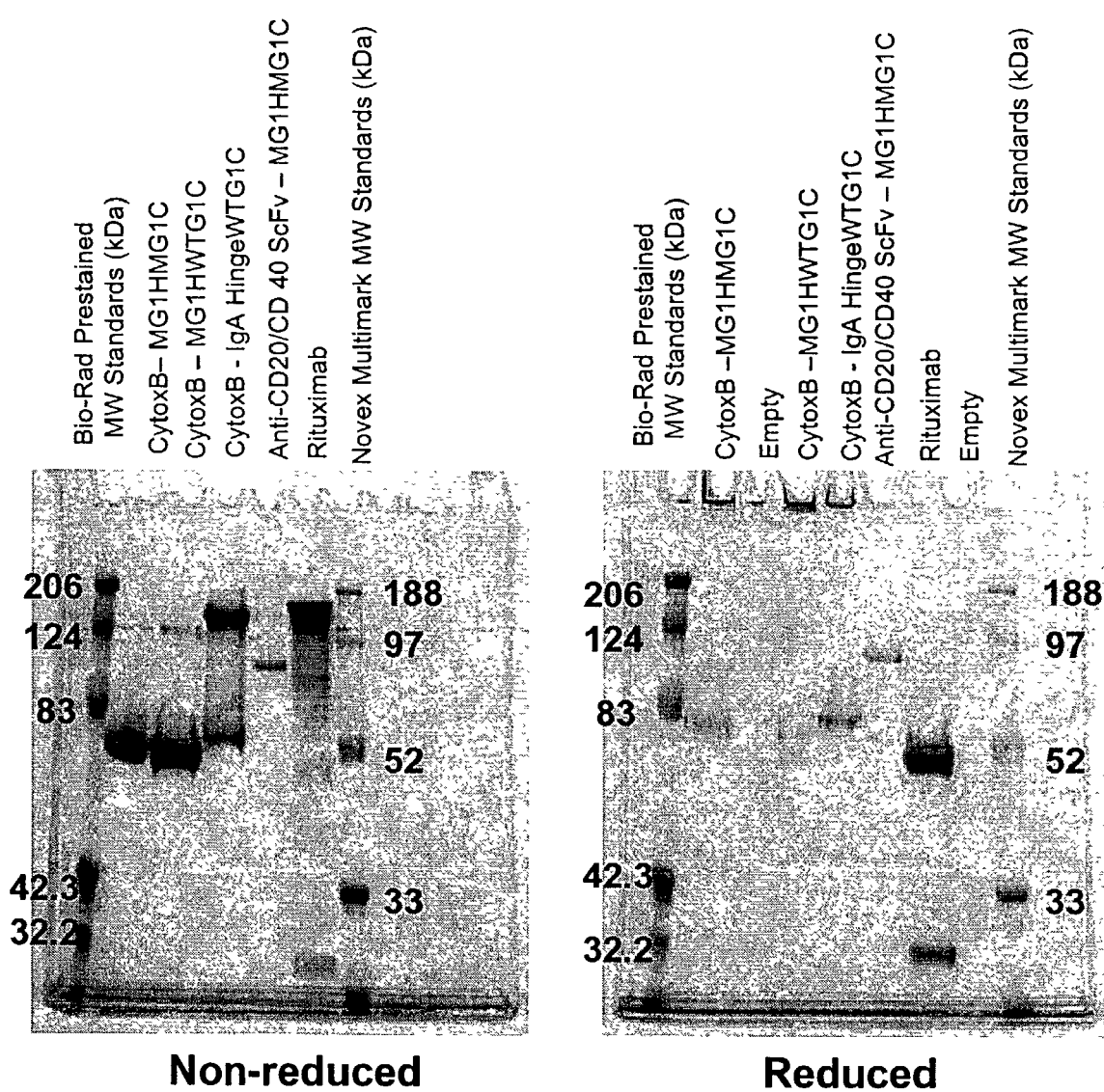
FIG. 12 shows SDS-PAGE analysis of isolated CytoxB and 2H7scFv-CD154 binding domain-immunoglobulin fusion proteins.

Purified fusion protein derivatives of CytoxB-scFvIg molecules were analyzed by SAS-PAGE according to the methods described in Example 2. Polyacrylamide gels were run under non-reducing and reducing conditions. Two different molecule weight marker sets, BIO RAD prestained markers, (BioRad, Hercules, Calif.) and Novex MULTIMARRK™ molecular weight markers were loaded onto each gel. The migration patterns of the different constructs and of rituximab are presented in FIG. 12.

Figure 13:
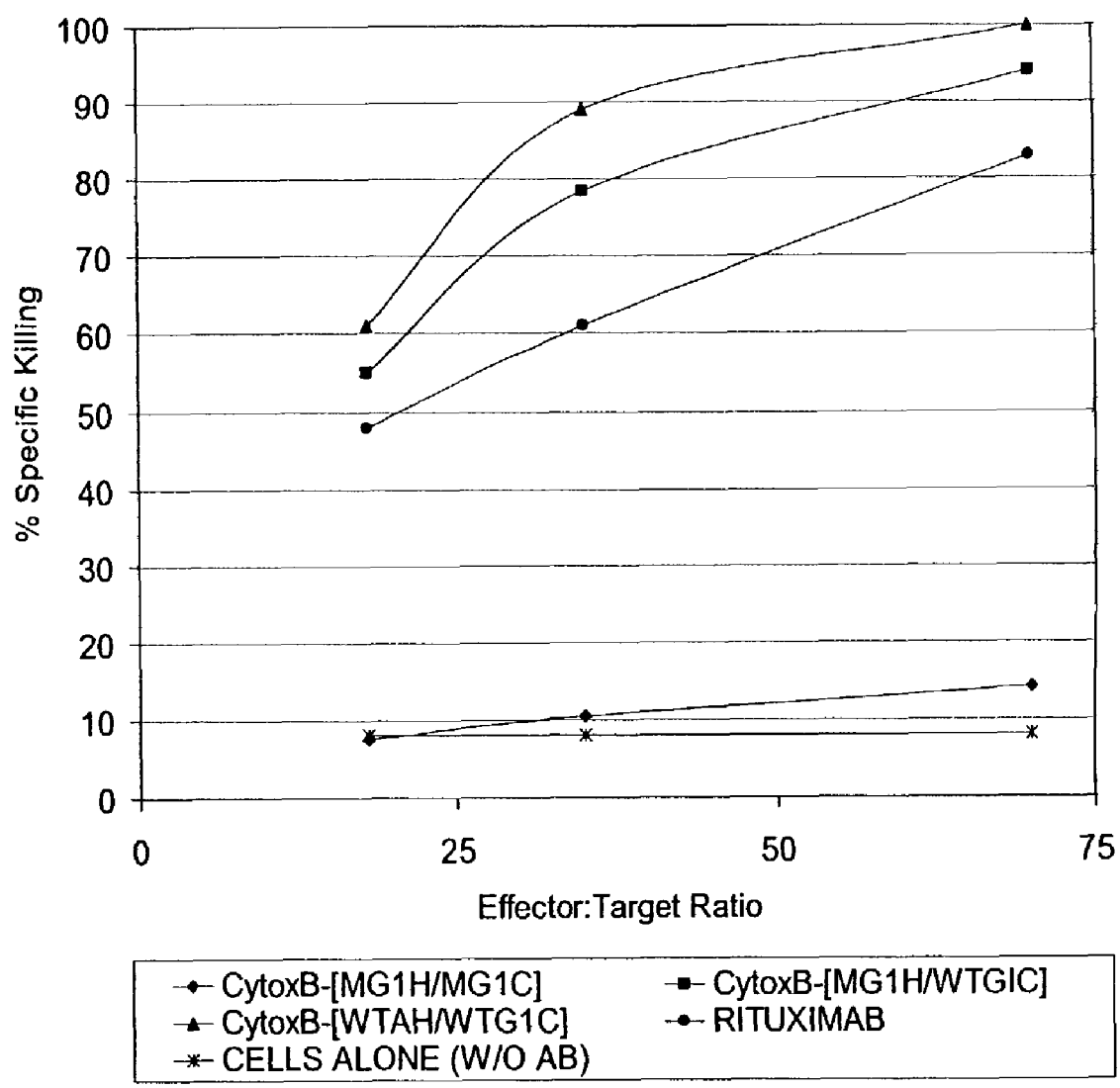
FIG. 13 shows antibody dependent cell-mediated cytotoxicity (ADCC) activity of CytoxB derivatives.

The ability of the different derivatives of CytoxB-scFvIg molecules to mediated ADCC was measured using the Bjab B lymphoma cells as the target and freshly prepared human PBMCs as effector cells, (See Example 2). Effector to target ratios were varied as follows: 70:1, 35:1, and 18:1, with the number of Bjab cells per well remaining constant but the number of PBMCs were varied. Bjab cells were labeled for 2 hours with $^{51}$Cr and aliquoted at a cell density of $5 \times 10^4$ cells/well to each well of flat-bottom 96 well plates. Purified fusion proteins or rituximab were added at a concentration of 10 mg/ml to the various dilutions of PBMCs. Spontaneous release was measured without addition of PBMC or fusion protein, and maximal release was measured by the addition of detergent (1% NP-40) to the appropriate wells. Reactions were incubated for 4 hours, and 100 µl of culture supernatant was harvested to a LUMAPLATE™ (Packard Instruments) and allowed to dry overnight prior to counting cpm released. The results are presented in FIG. 13.

Figure 14:
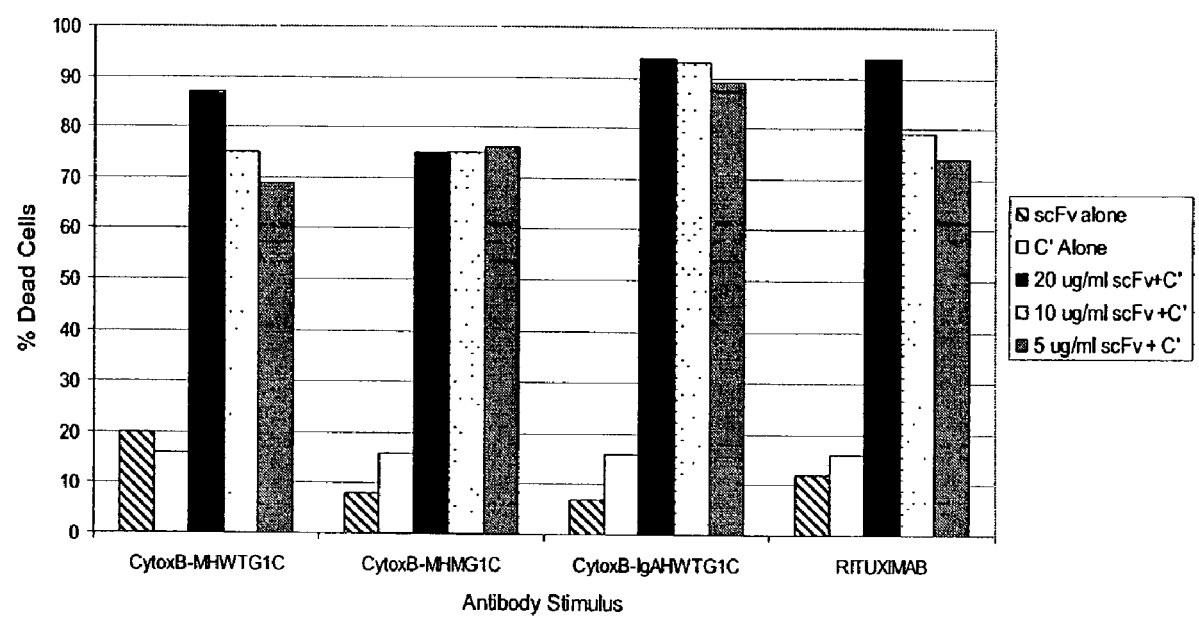
FIG. 14 shows complement dependent cytotoxicity (CDC) of CytoxB derivatives.

Complement dependent cytotoxicity (CDC) activity of the CytoxB derivatives was also measured. Reactions were performed essentially as described in Example 2. The results are presented in FIG. 14 as percent of dead cells to total cells for each concentration of fusion protein.

Example 6

In Vivo Studies in Macaques

Figure 15:
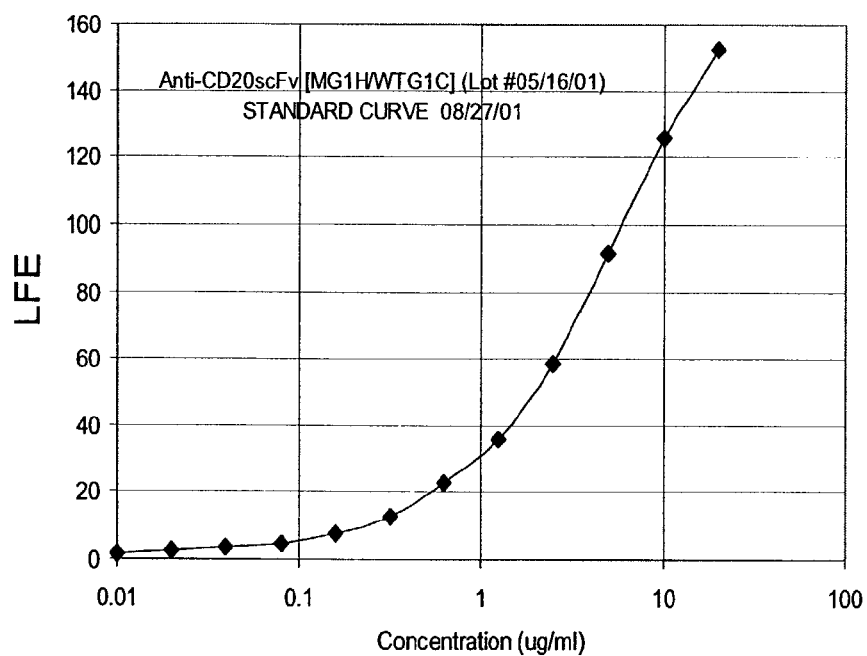
FIG. 15 shows serum half-life determinations of CytoxB-MHWTG1C in macaque blood samples.

Initial in vivo studies with CytoxB derivatives have been performed in nonhuman primates. FIG. 15 shows data characterizing the serum half-life of CytoxB in monkeys. Measurements were performed on serum samples obtained from two different macaques (J99231 and K99334) after doses of 6 mg/kg were administered to each monkey on the days indicated by arrows. For each sample, the level of 2H7scFvIg present was estimated by comparison to a standard curve generated by binding of purified CytoxB-(MHWTG1C)-Ig fusion protein to CD20 CHO cells (see Example 2). The data are tabulated in the bottom panel of the FIG. 15.

Figure 16:
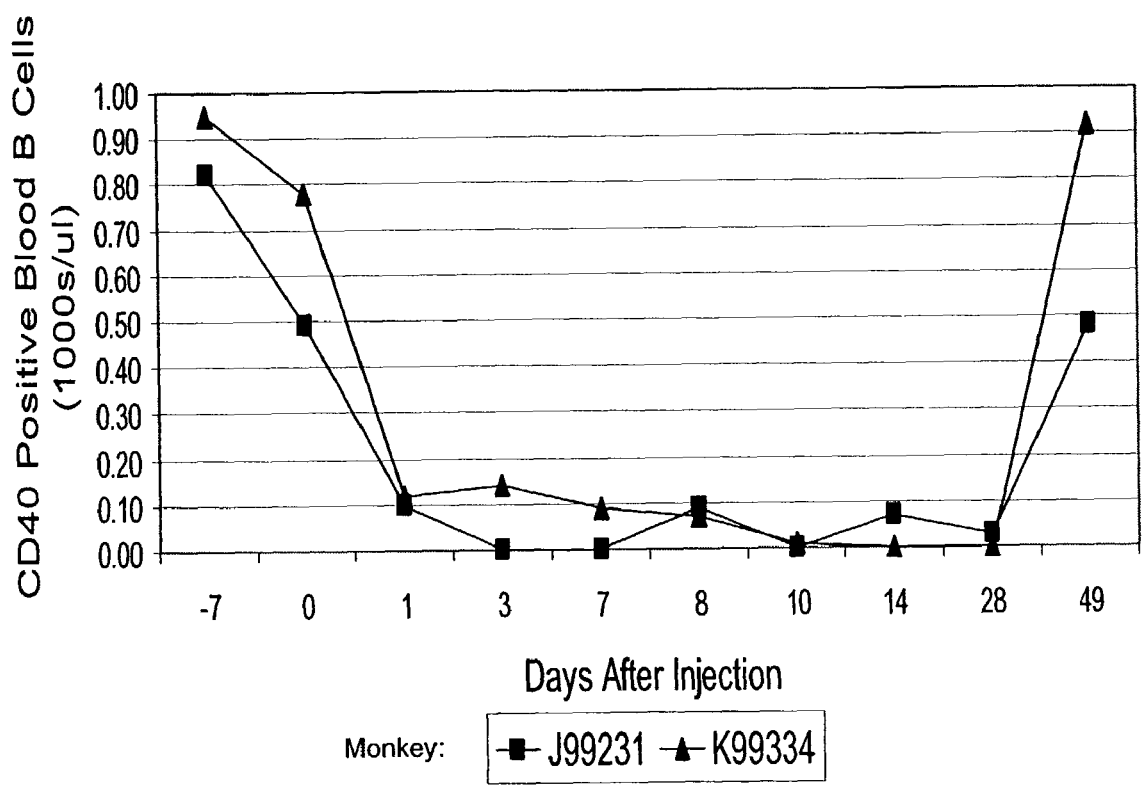
FIG. 16 shows effects of CytoxB-MHWTG1C on levels of circulating CD40+ B cells in macaque blood samples.

The effect of CytoxB-(MHWTG1C)Ig fusion protein on levels of circulating CD40+ cells in macaques was investigated. Complete blood counts were performed at each of the days indicated in FIG. 16. In addition, FACS (fluorescence activated cell sorter) assays were performed on peripheral blood lymphocytes using a CD40-specific fluorescein conjugated antibody to detect B cells among the cell population. The percentage of positive cells was then used to calculate the number of B cells in the original samples. The data are graphed as thousands of B cells per microliter of blood measured at the days indicated after injection (FIG. 16).

Example 7

Construction and Expression of an Anti-CD19 scFv-Ig Fusion Protein

Figure 17:
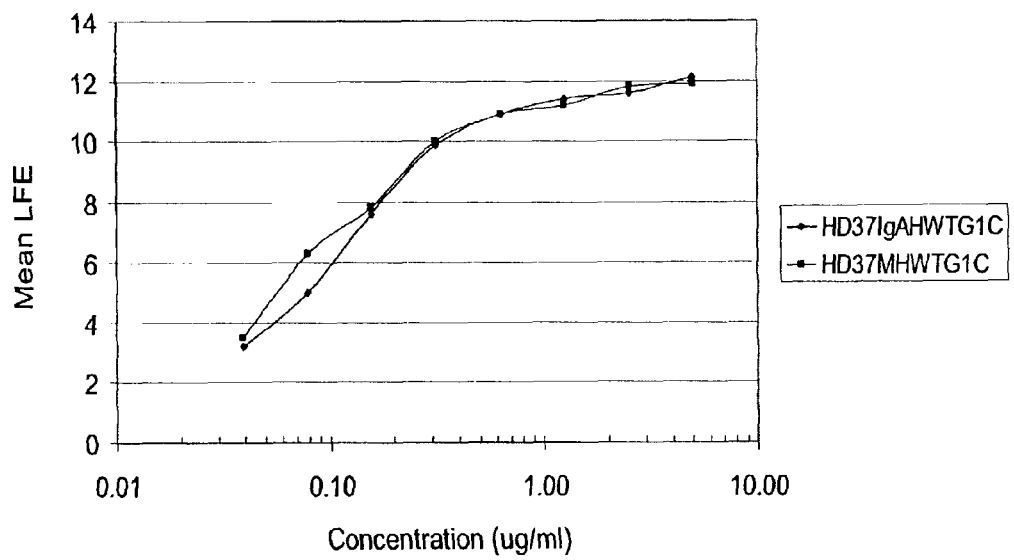
FIG. 17 shows production levels of HD37 (CD19-specific) ScFv-Ig by transfected mammalian cell lines and generation of a standard curve by binding of purified HD37 ScFv-Ig to cells expressing CD19.

An anti-CD19 scFv-Ig fusion protein was constructed, transfected into eukaryotic cells, and expressed according to methods presented in Examples 1, 2, and 5 and standard in the art. The variable heavy chain regions and variable light chain regions were cloned from RNA isolated from hybridoma cells producing antibody HD37, which specifically binds to CD19. Expression levels of a HD37scFv-IgAHWTG1C and a HD37scFv-IgMHWTG1C were measured and compared to a standard curve generated using purified HD37 scFvIg. The results are presented in FIG. 17.

Example 8

Construction and Expression of an Anti-L6 scFv-Ig Fusion Protein

Figure 18:
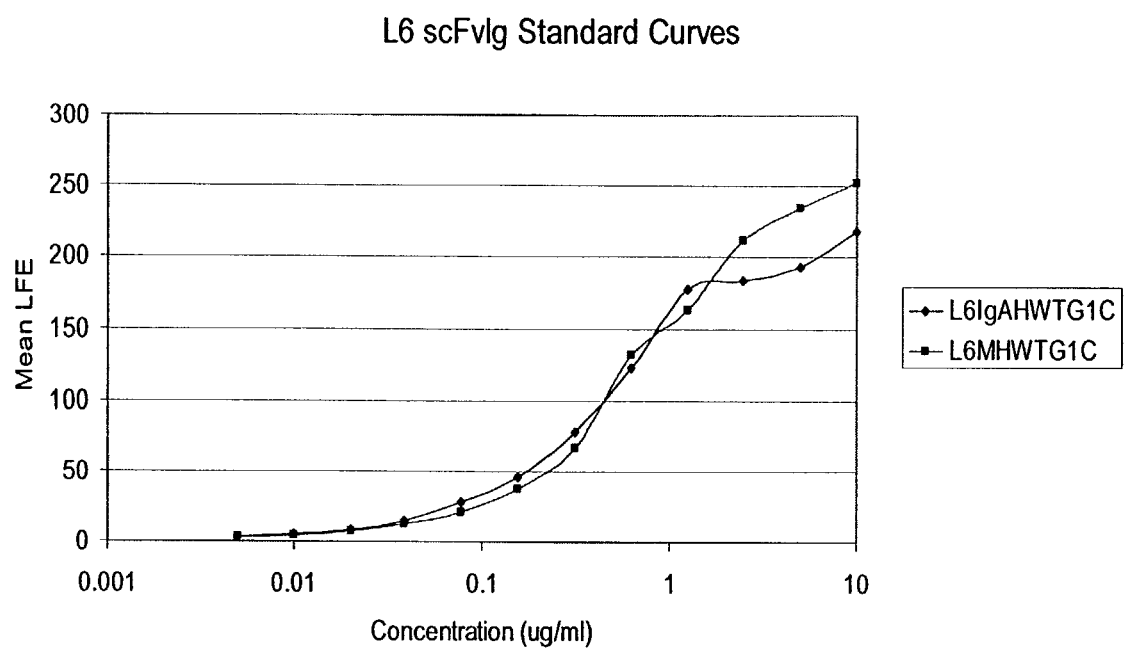
FIG. 18 shows production levels of L6 (carcinoma antigen) ScFv-Ig by transfected, stable CHO lines and generation of a standard curve by binding of purified L6 ScFv-Ig to cells expressing L6 antigen.

An scFv-Ig fusion protein was constructed using variable regions derived from an anti-carcinoma mAb, L6. The fusion protein was constructed, transfected into eukaryotic cells, and expressed according to methods presented in Examples 1, 2, and 5 and standard in the art. Expression levels of L6scFv-IgAHWTG1C and L6scFv-IgMHWTG1C were measured and compared to a standard curve generated using purified HD37 scFvIg. The results are presented in FIG. 18.

Example 9

Characterization of Various scFv-Ig Fusion Proteins

Figure 20:
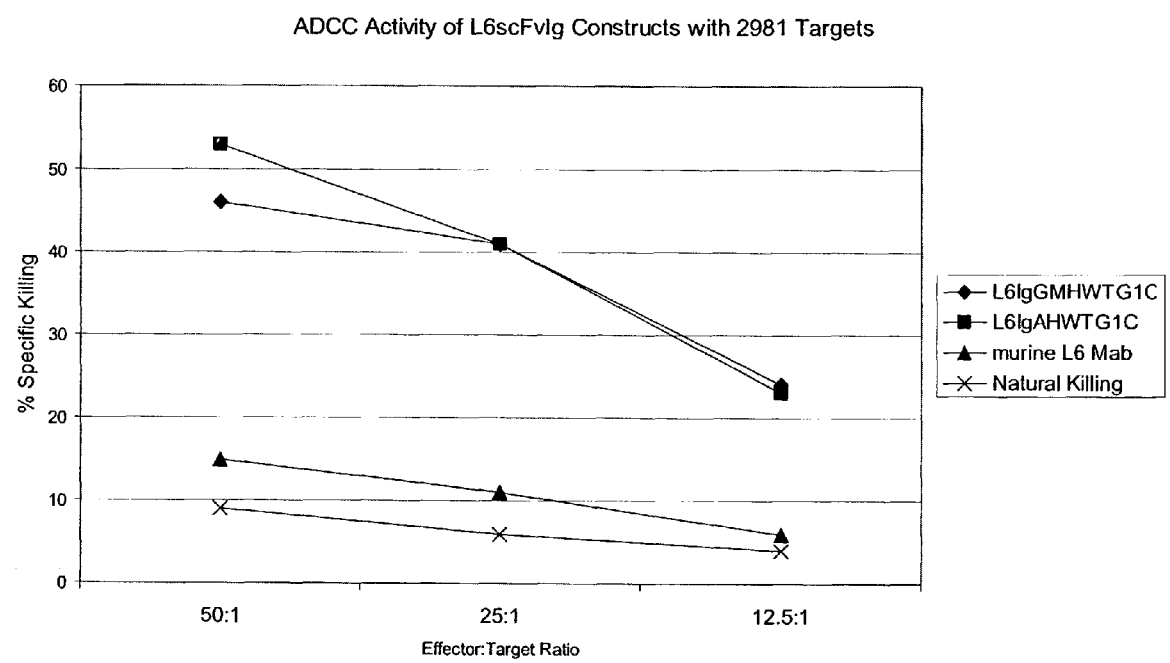
FIG. 20 shows ADCC activity of L6 ScFv-Ig fusion proteins.

In addition to the scFv-Ig fusion protein already described, G28-1 (anti-CD37) scFv-Ig fusion proteins were prepared essentially as described in Examples 1 and 5. The variable regions of the heavy and light chains were cloned according to methods known in the art. ADCC activity of 2H7-MHWTG1C, 2H7-IgAHWTG1C, G28-1-MHWTG1C, G28-1 IgAHWTG1C, HD37-MHWTG1C, and HD37-IgAHWTG1C was determined according to methods described above (see Example 2). Results are presented in FIG. 19. ADCC activity of L6scFv-IgAHWTG1C and L6scFv-IgMHWTG1C was measured using the 2981 human lung carcinoma cell line. The results are presented in FIG. 20. The murine L6 monoclonal antibody is known not to exhibit ADCC activity.

Figure 21:
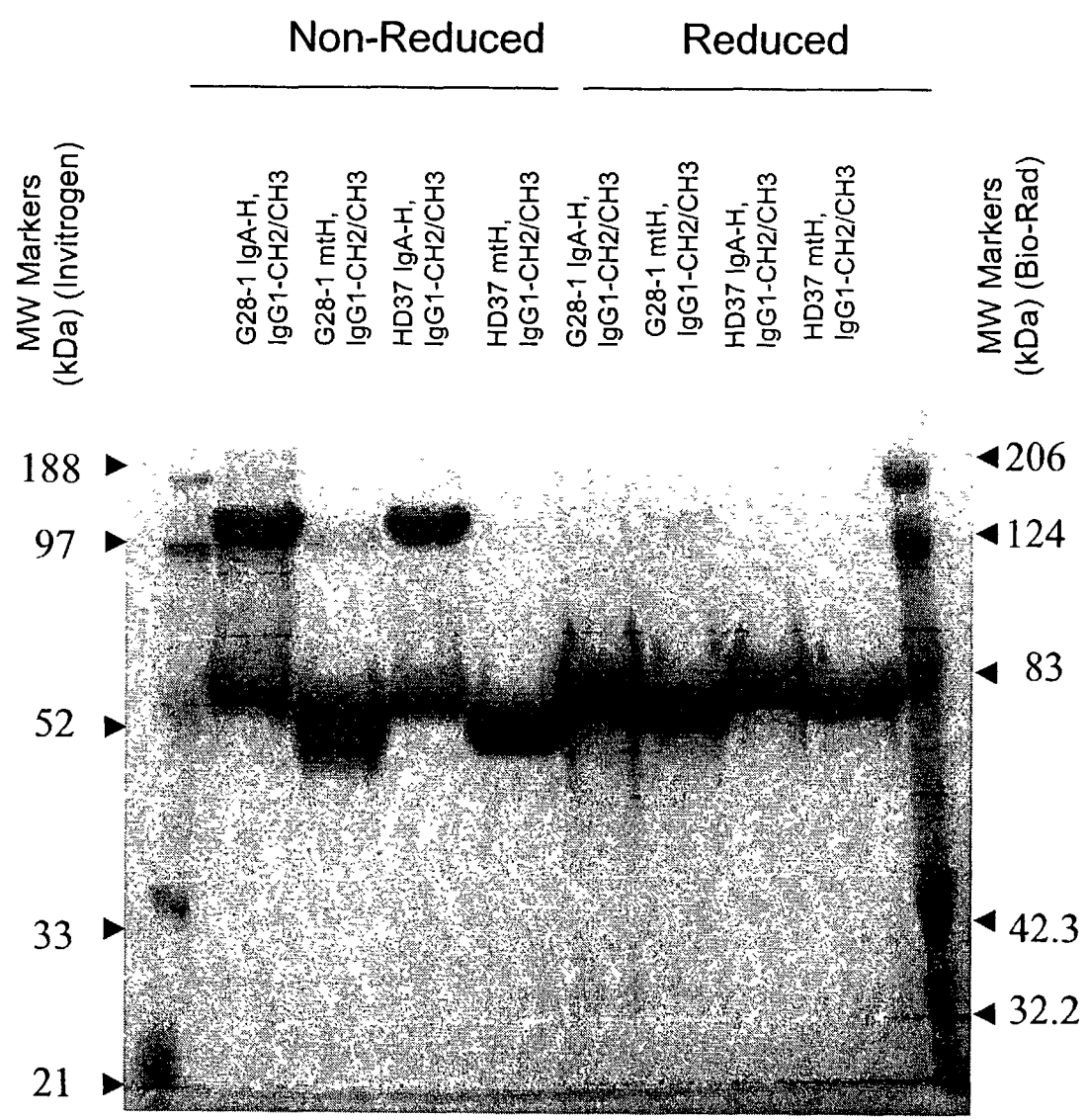
FIG. 21 shows SDS-PAGE analysis of L6 ScFv-Ig and 2H7 ScFv-Ig fusion proteins.
Figure 22:
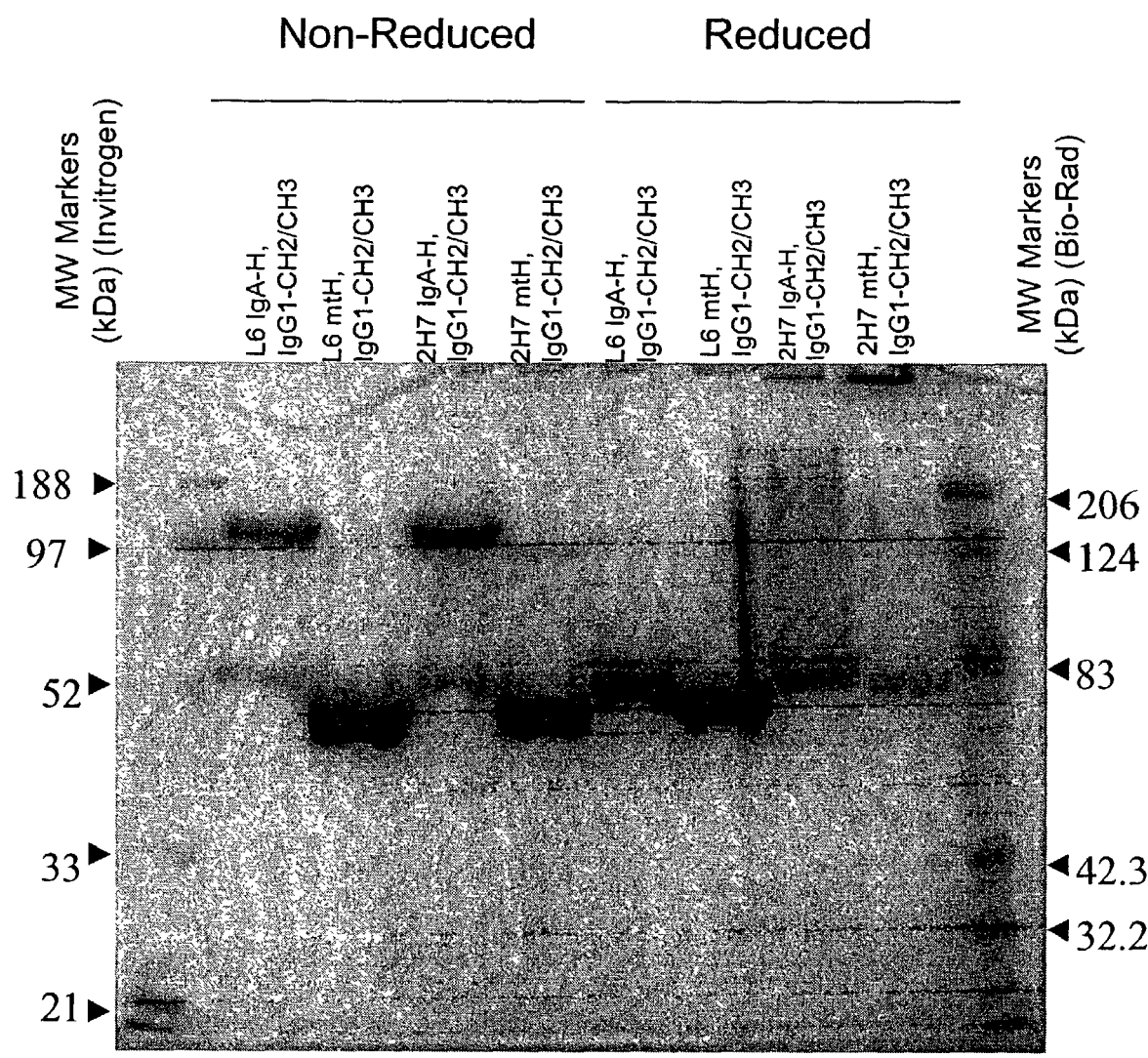
FIG. 22 shows SDS-PAGE analysis of G28-1 ScFv-Ig and HD37 ScFv-Ig fusion proteins.

The purified proteins were analyzed by SDS-PAGE under reducing and non-reducing conditions. Samples were prepared and gels run essentially as described in Examples 2 and 5. The results for the L6 and 2H7 scFv-Ig fusion proteins are presented in FIG. 21 and the results for the G28-1 and HD37 scFv-Ig fusion proteins are presented in FIG. 22.

Example 10

Construction and Expression of Anti-CD20 scFv-Llama Ig Fusion Proteins

This Example illustrates the cloning of llama IgG1, IgG2, and IgG3 constant region domains and the construction of immunoglobulin fusion proteins with each of the three constant regions and anti-CD20 scFv.

The constant regions of llama IgG1, IgG2, and IgG3 immunoglobulins were cloned and inserted into mammalian vector constructs containing an anti-CD20 single chain Fv, 2H7 scFv. Total RNA was isolated from peripheral blood mononuclear cells (PBMC) from llama blood (Triple J Farms, Bellingham, Wash.) by lysing the lymphocytes in TRIZOL® (Invitrogen Life Technologies, Carlsbad, Calif.) according to the manufacturer's instructions. One microgram (1 μg) of total RNA was used as template to prepare cDNA by reverse transcription. The RNA and 200 ng random primers were combined and denatured at 72° C. for 10 minutes prior to addition of enzyme. Superscript II reverse transcriptase (Invitrogen Life Technologies) was added to the RNA plus primer mixture in a total volume of 25 μl in the presence of SX second strand buffer and 0.1 M DTT provided with the enzyme. The reverse transcription reaction was allowed to proceed at 42° C. for one hour. The cDNA was amplified by PCR using sequence specific primers. The 5' primers were designed according to published sequences for the $V_{HH}$ and $V_H$ domains of camelids. The 3' primer, which was used to amplify all three isotypes, was designed using mammalian CH3 domain sequences as a guide. The following specific primers were used. The BclI and XbaI sites are indicated by underlined italicized sequences.

```
5' primer for llama IgG1 constant region
LLG1-5'bgl: 5'-gtt gtt gat caa gaa cca cat gga gga tgc acg tg-3'         (SEQ ID NO:
                                                                          227)

5' primer for llama IgG2 constant region
LLG2-5'bgl: 5'-gtt gtt gat caa gaa ccc aag aca cca aaa cc-3'              (SEQ ID NO:
                                                                          228)
```

-continued

```
5' primer for llama IgG3 constant region
LLG3-5'bgl:  5'-gtt gtt gat caa gcg cac cac agc gaa gac ccc-3'           (SEQ ID NO:
                                                                          229)

3' primer for llama IgG1, IgG2, and IgG3 constant regions
LLG123-3'X:  5'-gtt gtt tct aga tta cta ttt acc cga aga ctg ggt gat gga-3'  (SEQ ID NO:
                                                                            238)
```

PCR fragments of the expected size were cloned into TOPO® cloning vectors (Invitrogen Life Technologies) and then were sequenced. The sense sequencing primer, LLseqsense, had the sequence 5'-ctg aga tcg agt tca gct g-3' (SEQ ID NO: 230), and the antisense primer, LLseqAS, had the sequence 5'-cct cct ttg gct ttg tct c-3' (SEQ ID NO: 231). Sequencing was performed as described in Example 1. FIG. 23 compares the amino acid sequence of the three isotype llama constant regions containing the hinge, CH2, and CH3 domains with the amino acid sequence of human IgG1 hinge, CH2, and CH3 domains.

After verifying the sequence, the amplified PCR products were digested with restriction enzymes BclI and XbaI to create compatible restriction sites. The digested fragments were then gel-purified, and the DNA was eluted using a QIAquick Gel Extraction Kit (QIAGEN, Valencia, Calif.). The 2H7scFv-Ig pD18 mammalian expression vector construct (see Example 2) was digested with BclI and XbaI to remove the human IgG hinge, CH2, and CH3 domains. The pD18 vector is a modified derivative of pcDNA3 that contains an attenuated DHFR gene, which serves as a selectable marker for mammalian expression (Hayden et al., *Tissue Antigens* 48:242-54 (1996)). The purified llama IgG1, IgG2, and IgG3 constant region PCR products were ligated by T4 DNA ligase (Roche Molecular Biochemicals, Indianapolis, Ind.) into the double-digested 2H7 scFv-pD18 vector at room temperature overnight according to the manufacturer's instructions. After ligation, the ligation products were transformed into *E. coli* DH5a bacteria (BD Biosciences, Palo Alto, Calif.) and plated according to standard molecular biology procedures and manufacturer's instructions. Isolated colonies were chosen to screen for transformants containing the correct inserts.

For expression of the encoded polypeptides, plasmid DNA from positive clones was transiently transfected into COS-7 cells using DEAE-dextran (Hayden et al., *Ther. Immunol.* 1:3-15 (1994)). COS-7 cells were seeded at approximately 3×10⁶ cells per 150 mm plate and grown overnight until the cells were about 75% confluent. Cells were then washed once with serum-free DMEM (Invitrogen Life Technologies, Grand Island, N.Y.). Transfection supernatant (10 ml) containing 400 µg/ml DEAE-dextran, 0.1 mM chloroquine, and 5 mg/ml of the DNA constructs were added to the cells, which were then incubated at 37° C. for 3-4 hrs. After incubation, cells were pulsed with 10 ml of 10% dimethyl sulfoxide (DMSO) in 1×PBS at room temperature for 2 minutes. Cells were then placed back into fully supplemented DMEM/10% FBS (1% L-glutamine, 1% penicillin/streptomycin, 1% sodium pyruvate, 1% MEM essential amino acids) (Invitrogen Life Technologies). After 24 hours, the media was replaced with serum-free fully supplemented DMEM (Invitrogen Life Technologies), and the cells were maintained up to 21 days with media changes every 3-4 days.

Ig-fusion proteins were purified by passing COS cell culture supernatants through Protein A Agarose (Repligen, Cambridge, Mass.) columns. After application of the culture supernatant, the Protein A columns were then washed with 1×PBS (Invitrogen Life Technologies). Bound Ig-fusion proteins were eluted with 0.1 M citric acid (pH 2.8), and the collected fractions were immediately neutralized with Tris base (pH 10.85). The fractions containing protein were identified by measuring the optical density ($A_{280}$) and then were pooled, dialyzed against 1×PBS, (Invitrogen Life Technologies) and filtered through a 0.2 µm filter.

Figure 24:
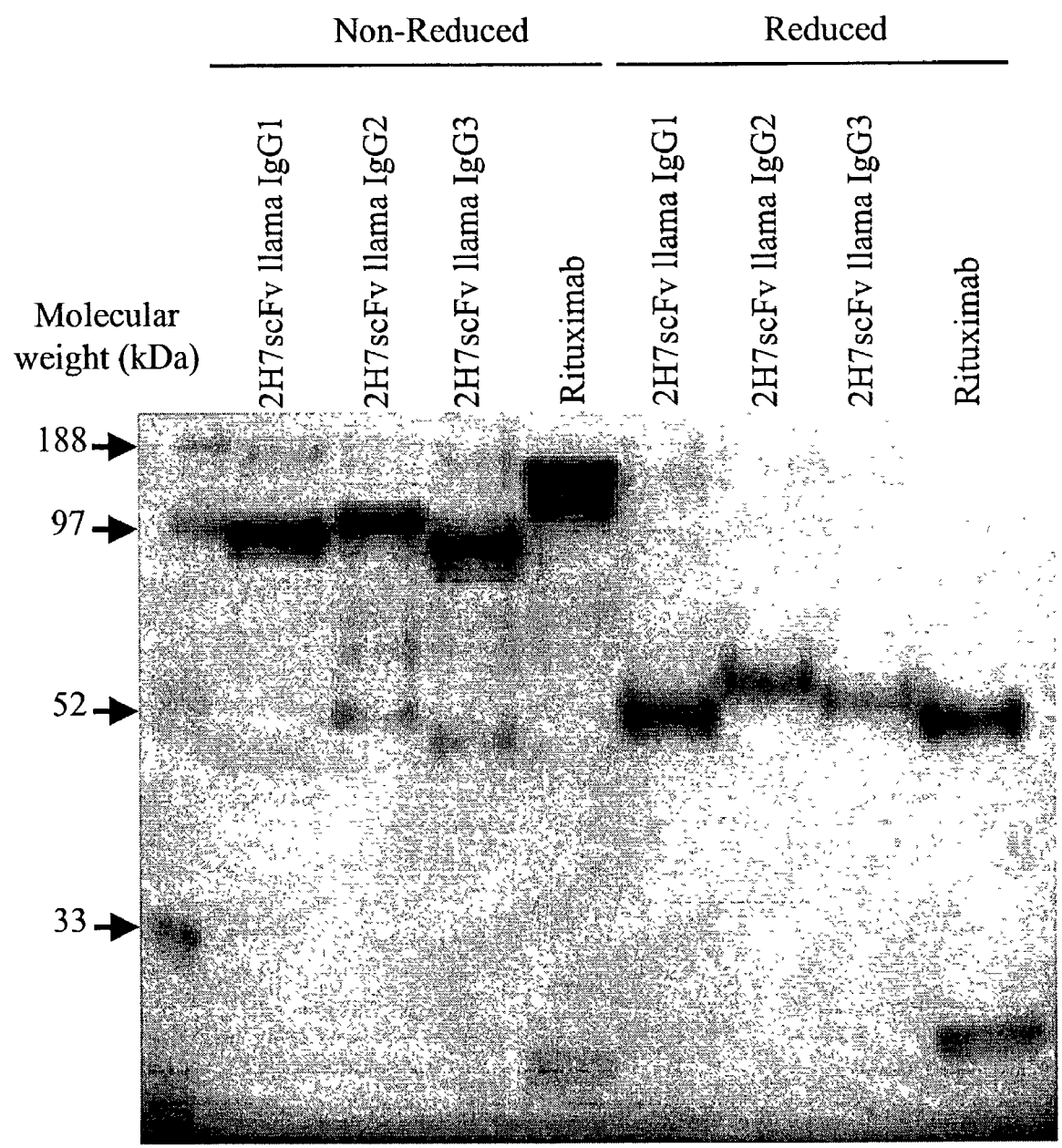
FIG. 24 illustrates migration of purified 2H7 scFv llama IgG fusion proteins in a 10% SDS polyacrylamide gel. Purified fusion proteins (5 .mu.g per sample) were prepared in non-reducing sample buffer (lanes 2-5) and in reducing sample buffer (lanes 6-9). Lane 1: molecular weight markers (non-reduced); lanes 2 and 6: 2H7 scFv-llama IgG1 (DNA sequence is set forth in SEQ ID NO: 452; amino acid sequence is set forth in SEQ ID NO: 453); Lanes 3 and 7: 2H7 scFv-llama IgG2 (DNA sequence is set forth in SEQ ID NO: 454; amino acid sequence is set forth in SEQ ID NO: 455); lanes 4 and 8: 2H7 scFv-llama IgG3 (DNA sequence is set forth in SEQ ID NO: 456; amino acid sequence is set forth in SEQ ID NO: 457); and Lanes 5 and 9: Rituximab (chimeric anti-CD20 antibody (human IgG1 constant region)).

The purified Ig-fusion proteins were analyzed by SDS-PAGE. Aliquots of 2H7 scFv-llama IgG1, 2H7 scFv-llama IgG2, 2H7 scFv-llama IgG3, and RITUXAN® (Rituximab, anti-CD20 antibody, Genentech, Inc. and IDEC Pharmaceuticals Corp.) (provided by Dr. Oliver W. Press, Fred Hutchison Cancer Research Center, Seattle, Wash.) (5 µg protein) were combined with 25 µl 2× NUPAGE® SDS Sample Buffer (Invitrogen Life Technologies) (non-reduced samples). Samples of each protein were also prepared in reducing sample buffer containing 5% 2-mercaptoethanol (Sigma-Aldrich, St. Louis, Mo.). Molecular weight markers (Invitrogen Life Technologies) were applied to the gels in non-reducing buffer only. The proteins were fractionated on NUPAGE® 10% Bis-Tris gels (Invitrogen Life Technologies). After electrophoresis (approximately 1 hour), the gels were washed three times, five minutes each, with Distilled Water (Invitrogen Life Technologies) and then stained in 50 ml Bio-Safe Coommassie Stain (BioRad, Hercules, Calif.) overnight at room temperature. After a wash in Distilled Water, the gels were photographed. The migration pattern of each Ig-fusion protein is presented in FIG. 24.

Figure 25:
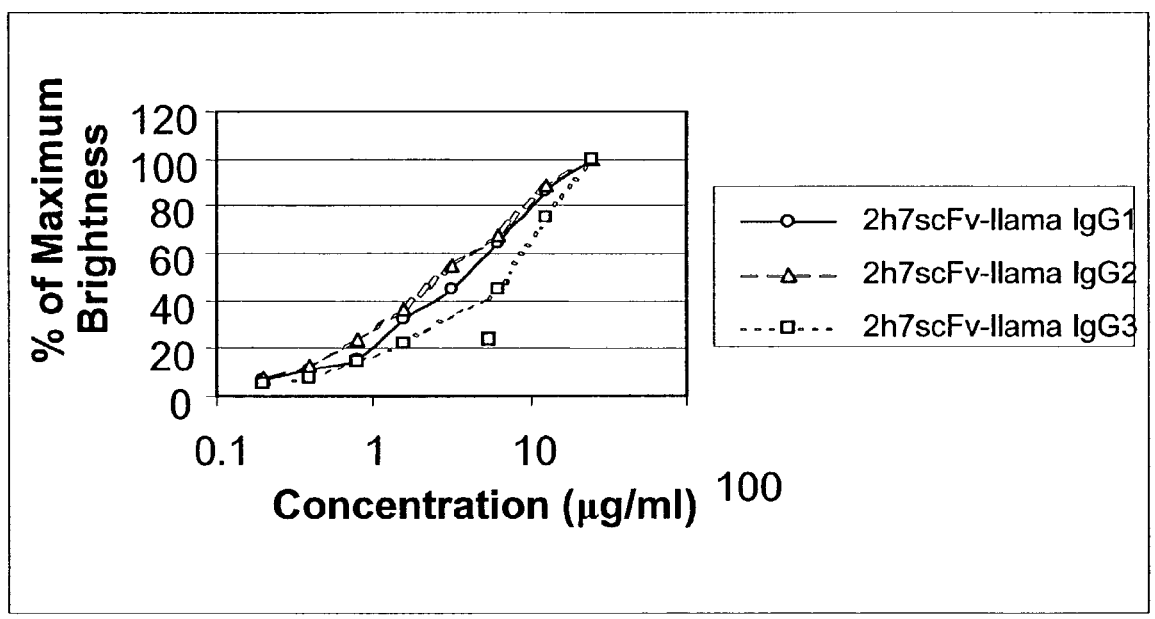
FIG. 25 shows binding of 2H7 scFv-llama IgG1 (DNA sequence is set forth in SEQ ID NO: 452; amino acid sequence is set forth in SEQ ID NO: 453), 2H7 scFv-llama IgG2 (DNA sequence is set forth in SEQ ID NO: 454; amino acid sequence is set forth in SEQ ID NO: 455), and 2H7 scFv-llama IgG3 (DNA sequence is set forth in SEQ ID NO: 456; amino acid sequence is set forth in SEQ ID NO: 457) to CD20+ CHO cells detected by flow immunocytofluorimetry.

The ability of the 2H7 scFv-llama Ig fusion proteins to bind to cells expressing CD20 was demonstrated by flow cytometry. Serial dilutions starting at 25 µg/ml of purified 2H7 scFv-llama IgG1, 2H7 scFv-llama IgG2, and 2H7 scFv-llama IgG3 were prepared and incubated with CD20-transfected (CD20+) CHO cells (from the laboratory of Dr. S. Skov, Institute of Medical Microbiology and Immunology, Copenhagen Denmark in 1% FBS 1×PBS media (Invitrogen Life Technologies) for one hour on ice. After the incubation, the cells were then centrifuged and washed with 1% FBS in 1×PBS. To detect bound 2H7 scFv-llama Ig, the cells were incubated for one hour on ice with fluorescein-conjugated goat anti-camelid IgG (heavy and light chain) (1:100) (Triple J Farms). The cells were then centrifuged and resuspended in 1% FBS-1×PBS and analyzed using a Coulter Epics XL cell sorter (Beckman Coulter, Miami, Fla.). The data (percent of maximum brightness) are presented in FIG. 25.

Example 11

Effector Function of Anti-CD20 scFv-Llama Ig Fusion Proteins

This Example demonstrates the ability of anti-CD20 llama IgG1, IgG2, and IgG3 fusion proteins to mediate complement dependent cytotoxicity (CDC) and antibody dependent cell-mediated cytotoxicity (ADCC).

Figure 26:
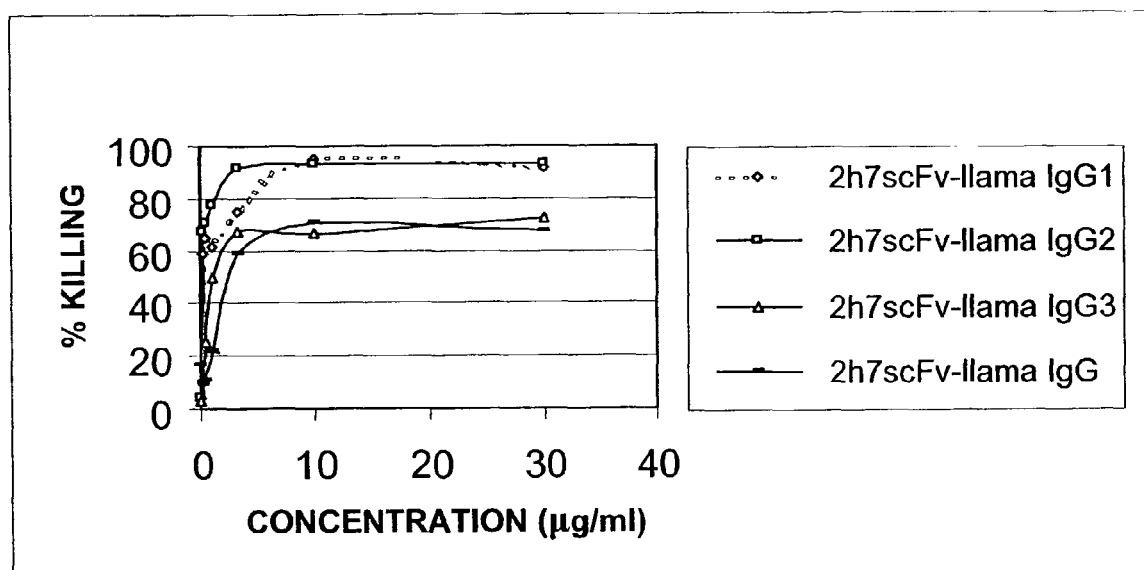
FIG. 26 depicts CDC activity of 2H7 scFv llama IgG fusion proteins, 2H7 scFv-llama IgG1 (DNA sequence is set forth in SEQ ID NO: 452; amino acid sequence is set forth in SEQ ID NO: 453), 2H7 scFv-llama IgG2 (DNA sequence is set forth in SEQ ID NO: 454; amino acid sequence is set forth in SEQ ID NO: 455), and 2H7 scFv-llama IgG3 (SEQ ID NO: DNA sequence is set forth in SEQ ID NO: 454; amino acid sequence is set forth in SEQ ID NO: 455), and 2H7 scFv human IgG1 (2H7 scFv IgG WTH WTCH2CH3) (DNA sequence is set forth in SEQ ID NO: 456; amino acid sequence is set forth in SEQ ID NO: 457) against BJAB cells in the presence of rabbit complement. Rituximab was included as a positive control.

The ability of the 2H7 scFv-llama IgG fusion proteins to kill CD20 positive cells in the presence of complement was tested using the BJAB human B cell line. Rabbit complement was obtained from 3-4 week old rabbits (Pel-Freez, Brown Deer, Wis.). BJAB cells (2×10⁶ cells/ml) were combined with rabbit complement (final dilution 1:10) and purified 2H7 Ig fusion proteins. 2H7 scFv-llama IgG1, 2H7 scFv-llama IgG2, 2117 scFv-llama IgG3, and 2H7 scFv-human IgG1 wild type hinge-CH2-CH3) (Example 1) were added at 1:3 serial dilutions beginning at a concentration of 30 pg/ml. After one hour at 37° C., cell viability was determined by counting live and dead cells by trypan blue exclusion (0.4%) (Invitrogen Life Technologies) using a hemacytometer (Bright-line, Horsham, Pa.). The percent killing was calculated by dividing the number of dead cells by the number of total cells (dead+live cells). The data presented in FIG. 26 show that all Ig fusion proteins had CDC activity.

Figure 27:
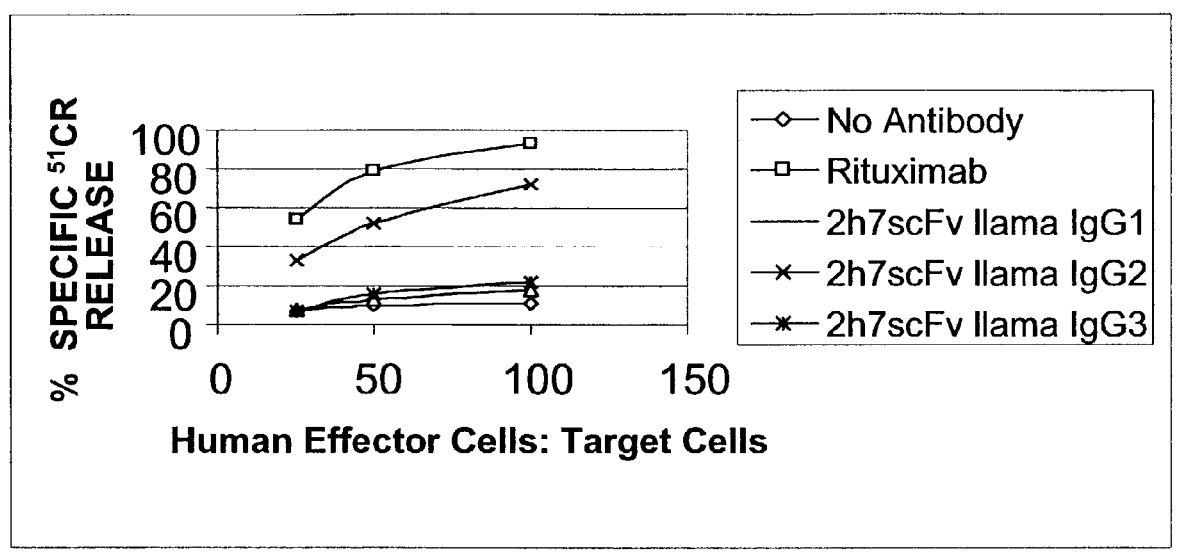
FIG. 27 shows ADCC activity of 2H7 scFv llama IgG fusion proteins, 2H7 scFv-llama IgG1 (DNA sequence is set forth in SEQ ID NO: 452; amino acid sequence is set forth in SEQ ID NO: 453), 2H7 scFv-llama IgG2 (SEQ ID NO: DNA sequence is set forth in SEQ ID NO: 454; amino acid sequence is set forth in SEQ ID NO: 455), and 2H7 scFv-llama IgG3 (DNA sequence is set forth in SEQ ID NO: 456; amino acid sequence is set forth in SEQ ID NO: 457). Effector cells (human PBMC) were combined with target cells (BJAB cells) at three different ratios, 1:25, 1:50, and 1:100. Rituximab was included as a positive control. Each data point represents three separate measurements.

The ADCC activity of the 2H7 scFv-llama IgG fusion proteins was determined using BJAB cells as target cells and human or llama peripheral blood mononuclear cells (PBMC) as effector cells. BJAB cells were pre-incubated for approximately 2 hours with 51Cr (100 μCi) (Amersham Biosciences, Piscataway, N.J.) in fully supplemented IMDM (Invitrogen. Life Technologies) containing 15% FBS. The cells were mixed intermittently during the pre-incubation period. Fresh, resting human PBMC were purified from whole blood using Lymphocyte Separation Media (LSM) (ICN Pharmaceuticals, New York, N.Y.). PBMC were combined with labeled BJAB cells (5×104 cells per well of 96 well tissue culture plate) at ratios of 25:1, 50:1, and 100:1. To each combination was added 10 μg/ml of purified 2H7 scFv-llama IgG1, 2H7 scFv-llama IgG2, 2H7 scFv-llama IgG3, Rituximab, or no anti-CD20 antibody. The mixtures were incubated for 6 hours at 37° C. Supernatant from each reaction containing 51Cr released from lysed cells was collected onto a LUMA-PLATE™-96 filter plate (Packard, Meriden, Conn.), which was dried overnight. The amount of 51Cr was measured by a TopCount NXT plate reader (Packard). FIG. 27 shows that the 2H7 scFv-llama IgG2 fusion protein was the most effective llama fusion protein in mediating ADCC. Each data point represents the average measurement of triplicate wells.

Figure 28:
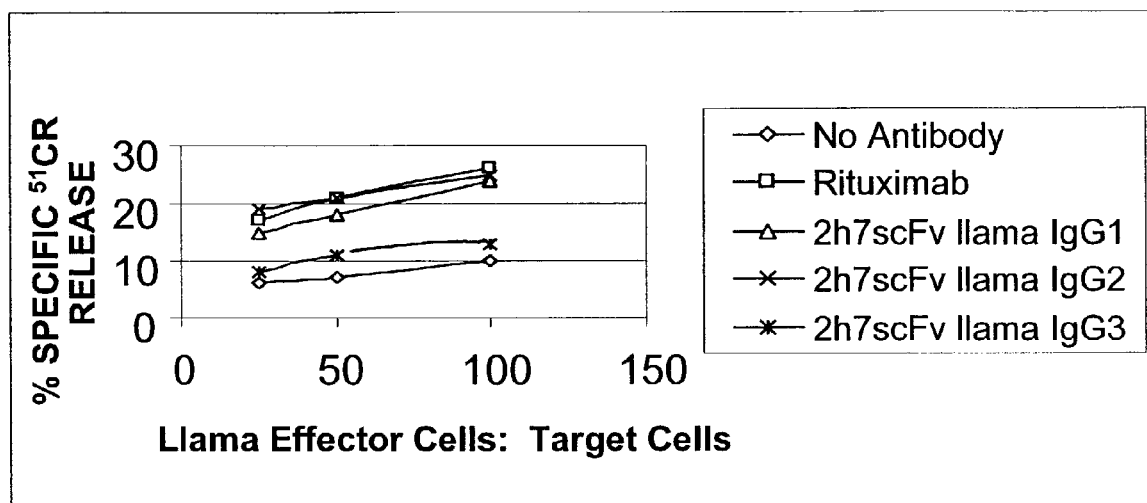
FIG. 28 shows ADCC activity of 2H7 scFv llama IgG fusion proteins, 2H7 scFv-llama IgG1 (DNA sequence is set forth in SEQ ID NO: 452; amino acid sequence is set forth in SEQ ID NO: 453), 2H7 scFv-llama IgG2 (DNA sequence is set forth in SEQ ID NO: 454; amino acid sequence is set forth in SEQ ID NO: 455), and 2H7 scFv-llama IgG3 (DNA sequence is set forth in SEQ ID NO: 456; amino acid sequence is set forth in SEQ ID NO: 457). Effector cells (llama PBMC) were combined with target cells (BJAB cells) at three different ratios, 1:25, 1:50, and 1:100. Rituximab was included as a positive control. Each data point represents three separate measurements.

ADCC activity was affected by the source of effector cells. Llama PBMC were isolated from llama blood (Triple J Farms) using LSM. Llama effector cells were added at the same ratios to BJAB target cells as described for the ADCC assay using human effector cells. The cells were combined with 10 μg/ml of purified 2H7 scFv-llama IgG1, 2H7 scFv-llama IgG2, 2H7 scFv-llama IgG3, Rituximab, or no anti-CD20 antibody. The results are presented in FIG. 28.

Example 12

Construction and Characterization of scFv Ig Fusion Proteins Expressed on the Cell Surface This Example describes a retroviral transfection system for ectopic surface expression of genetically engineered cell surface receptors composed of scFvs that bind costimulatory receptors. The Example also demonstrates the effector function of these various scFv Ig fusion proteins expressed on the surface of target cells.

The heavy and light chain variable regions were cloned from murine monoclonal antibodies specific for various costimulatory receptors, and single chain Fv constructs were prepared essentially as described in Example 1. Antibodies included 2H7, anti-human CD20; 40.2.220, anti-human CD40; 2E12, anti-human CD28; 10A8, anti-human CD152 (anti-CTLA-4); and 500A2, anti-murine CD3. The heavy chain and light chain variable regions of each antibody were cloned according to standard methods for cloning immunoglobulin genes and as described in Example 1. Single chain Fv constructs were prepared as described in Example 1 by inserting a nucleotide sequence encoding a (gly₄ser)₃ peptide linker between the VL region nucleotide sequence of 40.2.220, 2E12, 10A8, and 500A2, respectively (SEQ ID NOs: 243 or 462; 249 or 468; 474; 263, respectively) and the VH region nucleotide sequence of 40.2.220, 2E12, 10A8, and 500A2, respectively (SEQ ID NOs: 245 or 464; _251 or _ 470; 261 or 476; 257, respectively). The polypeptide sequence for VL of 40.2.220, 2E12, 10A8, and 500A2 are set forth in SEQ ID NOs: 244 or 463; 250 or 469; 255 or 475; 264, respectively, and the polypeptide sequence for VH of 40.2.220, 2E12, 10A8, and 500A2 are set forth in SEQ ID NOs: 246 or 465 ; 252 or 471; 258 or 477; 262, respectively. Each scFv polynucleotide (SEQ ID NOs: 247 or 466; 253 or 472; 259 or 478; 399 for 40.2.220, 2E12, 10A8, and 500A2, respectively) was then fused to human IgG1 mutant hinge (CCC→SSS) and mutant CH2 (proline to serine mutation at residue 238 (238 numbering according to EU nomenclature, Ward et al., 1995 *Therap. Immunol.* 2:77-94; residue 251 according to Kabat et al.) and wild type CH3 domains according to the methods described in Example 5 and 11. Each scFv mutant IgG1 fusion polynucleotide sequence was then fused in frame to sequences encoding the transmembrane domain and cytoplasmic tail of human CD80 (SEQ ID NO: 460), such that when the fusion protein was expressed in the transfected cell, CD80 provided an anchor for surface expression of the scFv Ig fusion protein. cDNAs encoding the scFv-IgG-CD80 fusion proteins (SEQ ID NOs: 268 or 483; 265 or 481; 270 or 485; 272 or 487 for 40.2.220-, 2E12-, 10A8-, and 500A2-scFv-IgG-CD80, respectively) were inserted into the retroviral vector pLNCX (BD Biosciences Clontech, Palo Alto, Calif.) according to standard molecular biology procedures and vendor instructions. The scFv-Ig-CD80 cDNA was inserted between the 5'LTR-neomycin resistance gene-CMV promoter sequences and the 3'LTR sequence. The retroviral constructs were transfected into Reh, an acute lymphocytic leukemia cell line (ATCC CRL-8286). Transfected cells were screened to select clones that were expressing scFv-Ig fusion proteins on the cell surface.

Figure 29:
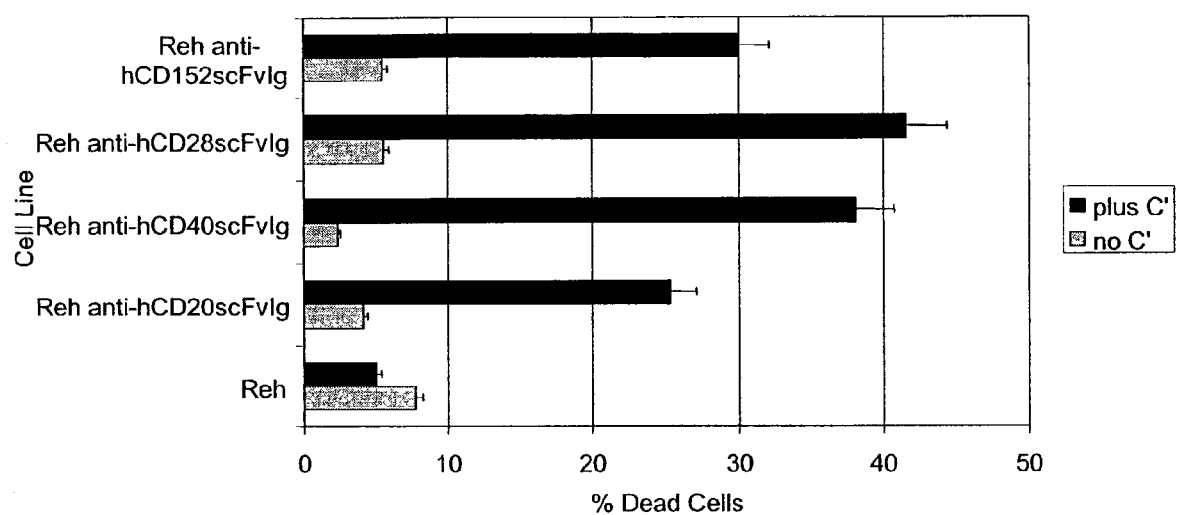
FIG. 29 depicts CDC activity of Reh cells (acute lymphocytic leukemia) expressing scFv-Ig fusion proteins on the cell surface. Reh cells were transfected with constructs encoding scFv antibodies specific for human costimulatory molecules, CD152, CD28, CD40, and CD20, fused to human IgG1 wild-type hinge-CH2—CH3, which was fused to human CD80 transmembrane and cytoplasmic tail domains. CDC activity was measured in the presence and absence of rabbit complement (plus C' and no C', respectively). The data represent the average of duplicate samples. Reh anti-hCD152 scFvIg: Reh cells transfected with polynucleotide 10A8 scFv IgG MTH (SSS) MT CH2CH3 (SEQ ID NOs: 270 and 485); Reh anti-hCD28scFvIg: 2E12 scFv IgG MTH (SSS) MT CH2CH3 (SEQ ID NOs: 268 and 483); Reh anti-hCD40scFvIg: 4.2.220 scFv IgG MTH (SSS) MT CH2CH3 (SEQ ID NOs: 266 and 481); and Reh anti-hCD20 scFvIg: 2H7 scFv IgG MTH (SSS) MT CH2CH3—CD80.

CDC and ADCC assays were performed with the transfected Reh cells to determine if expression of the scFv-Ig polypeptides on the cell surface augmented effector cell function. Reh cells expressing anti-human CD152 scFv-mutant IgG-CD80 (SEQ ID NO: 270 or 485); Reh anti-human CD28 scFv-mutant IgG-CD80 (SEQ ID NOS: 268 or 483); Reh anti-human CD40 scFv-mutant IgG-CD80 (SEQ ID NOS: 265 or 481); Reh anti-human CD20 scFv-mutant IgG-CD80 were combined with human PBMC (see Example 11) and rabbit complement (10 μg/ml) for one hour at 37° C. Untransfected Reh cells were included as a control. Viability of the cells was determined by trypan blue exclusion, and the percent of killed cells was calculated (see Example 11). FIG. 29 shows the effectiveness of the scFv-IgG-CD80 fusion proteins when expressed on the cell surface of tumor cells to mediate complement dependent cytotoxicity.

Figure 30:
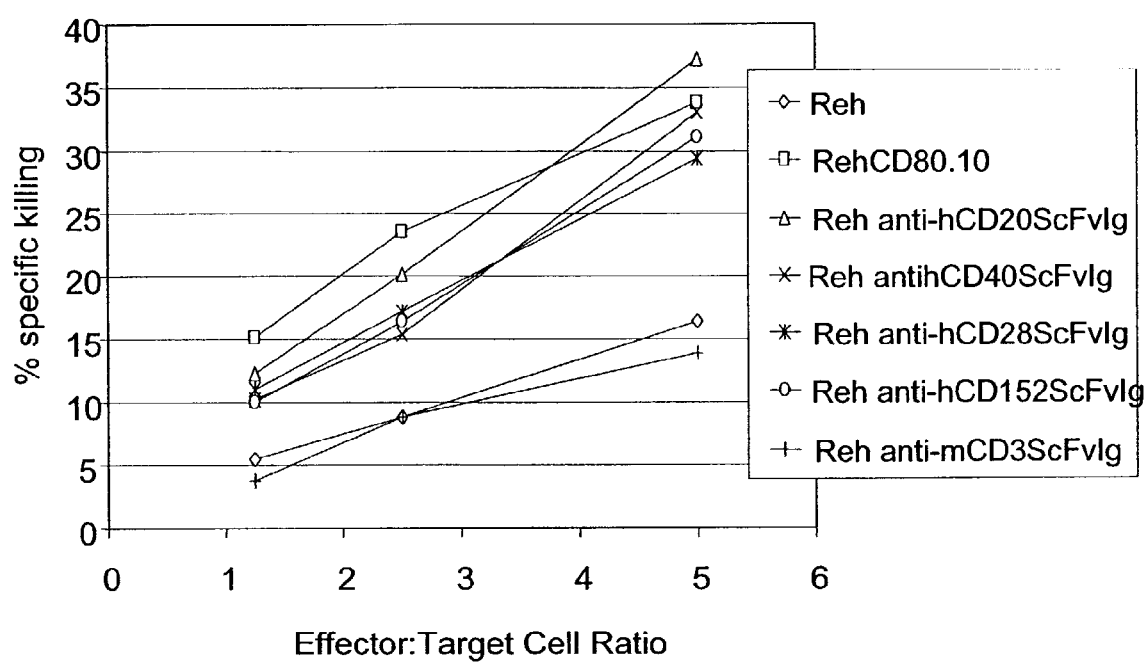
FIG. 30 presents ADCC activity of Reh cells that were transfected with constructs encoding scFv antibodies specific for human costimulatory molecules, CD152, CD28, CD40, and CD20, as described for FIG. 29, and for murine CD3, fused to human mutant IgG1 hinge and mutant CH2 and wild type CH3 (Reh anti-mCD3scFv designating Reh cells transfected with polynucleotide 500A2 scFv IgG MTH (SSS) MTCH2WTCH3 SEQ ID NO: 272 and 487)), which was fused to human CD80 transmembrane and cytoplasmic tail domains. The data represent the average of quadruplicate samples.

The same transfected Reh cells tested in the CDC assay plus Reh cells transfected with the polynucleotide construct that encodes anti-murine CD3-scFv-Ig-CD80 (SEQ ID NO: 486) were analyzed for ADCC activity (see Example 11). Untransfected and transfected Reh cells were pre-labeled with ⁵¹Cr (100 μCi) (Amersham) for two hours at 37° C. Human PBMC served as effector cells and were added to the Reh target cells (5×10⁴ cells per well of 96 well plate) at ratios of 5:1, 2.5:1, and 1.25:1. After five hours at 37° C., culture supernatants were harvested and analyzed as described in Example 11. Percent specific killing was calculated according to the following equation: ((experiment release minus spontaneous release)/(maximum release minus spontaneous release))×100. The data are presented in FIG. 30. Each data point represents the average of quadruplicate samples.

Using the same procedures described above, the same results with other binding domains were obtained using the following monoclonal antibodies mAbs as sources of sFv: for CD20, 1F5 (Genbank AY 058907 and AY058906); for CD40, 2.36 and G28.5; for CD28, 9.3.

Cell surface expression of antibody binding domains is accomplished by fusing antibody scFvs to IgA hinge and constant regions and IgE hinge and constant regions. Polynucleotides encoding an anti-4-1BB scFv, 5B9 (anti-human 4-1BB) scFv, and 2e12 (anti-human CD40) fused to IgAH IgA T4 (four terminal CH3 residues deleted) fused to the CD80 transmembrane and cytoplasmic domains and IgE Fc regions are shown in SEQ ID NOs: 626 and 630. The encoded polypeptides are shown in SEQ ID NOs: 627 and 631.

Example 13

Construction and Sequence of Human Ig Hinge-CH2-CH3 Mutants and 2H7 Variable Region Mutants This Example describes construction of scFv fusion proteins containing mutant human IgG1 and IgA constant regions. This Example also describes construction of a 2H7 scFv mutant with a single point mutation in the variable heavy chain region. Mutations were introduced into variable and constant region domains according to methods described herein and known in the molecular biology arts. FIG. 31 presents nomenclature for the Ig constant region constructs.

The human IgG1 hinge region of the 2H7 scFv human IgG1 hinge-CH2-CH3 fusion proteins was mutated to substitute cysteine residues that in a whole immunoglobulin are involved in forming disulfide bonds between two heavy chain molecules. One mutant, 2H7 scFv fused to a human IgG1 hinge region in which all three cysteine residues were mutated to serine residues (MTH (SSS)), was prepared as described in Example 5 (designated in Example 5 as CytoxB-MHWTG1C (includes wild type IgG1 CH2 and CH3 domains)) (now referred to as 2H7 scFv MTH (SSS) WTCH2CH3) and comprises the polynucleotide sequence SEQ ID NO: 4 encoding the polypeptide as set forth in SEQ ID NO: 17. The polynucleotide sequence encoding this mutant (SEQ ID NO: 4) was used as a template to create mutant hinge regions in which the first two cysteine residues were substituted with serine residues (IgG MTH (SSC)). An oligonucleotide was designed to substitute the third serine residue with a cysteine and had the following sequence: 5'-gtt gtt gat cag gag ccc aaa tct tct gac aaa act cac aca tct cca ccg tgc cca gca cct g-3' (HuIgGMHncs3, SEQ ID NO: 275). A second mutant was prepared in which the mutant hinge had serine residues substituting the first and third cysteine residues (IgG MTH (SCS)). The sequence of the oligonucleotide to create this mutant was as follows: 5'-gtt gtt gat cag gag ccc aaa tct tct gac aaa act cac aca tgc cca ccg-3' (HuIgGMHncs2, SEQ ID NO: 276). A third mutant was prepared with cysteine residues substituted at the second and third positions (IgG MTH (CSS)), also using the IgG MTH (SSS) mutant as template, and an oligonucleotide having the sequence, 5'-gtt gtt gat cag gag ccc aaa tct tgt gac aaa act cac-3' (HuIgGMHncs1, SEQ ID NO: 277).

The oligonucleotides introducing the mutations into the hinge region were combined with template and a 3' oligonucleotide containing an XbaI site (underlined and italicized) (5'-gtt gtt tct aga tca ttt acc cgg aga cag gga gag gct ctt ctg cgt gta g-3' (SEQ ID NO: 278)) to amplify the mutant hinge-wild type (WT)-CH2-CH3 sequences by PCR. The IgG MTH CSS and IgG MTH SCS mutant sequences were amplified for 25 cycles with a denaturation profile of 94° C., annealing at 52° C. for 30 seconds, and extension at 72° C. for 30 seconds. The IgG MTH SSC mutant sequence was amplified under slightly different conditions: denaturation profile of 94° C., annealing at 45° C. for 30 seconds, and extension at 72° C. for 45 seconds. The amplified polynucleotides were inserted into the TOPO® cloning vector (Invitrogen Life Technologies) and then were sequenced as described in Example 1 to confirm the presence of the mutation. pD18 vector containing 2H7 scFv was digested to remove the constant region sequences essentially as described in Example 10. The mutant hinge-wild type CH2-CH3 regions were inserted in frame into the digested vector DNA to obtain vectors comprising 2H7 scFv MTH (CSS) WTCH2CH3 encoding DNA (SEQ ID NO: 581); 2H7 scFv MTH (SCS) WTCH2CH3 encoding DNA (SEQ ID NO: 583); and 2H7 scFv MTH (SSC) WTCH2CH3 encoding DNA (SEQ ID NO: 585).

A mutation of leucine to serine at position 11 in the first framework region of the heavy chain variable region (numbering according to Kabat et al., *Sequences of Proteins of Immunological Interest*, 5$^{th}$ ed. Bethesda, Md.: Public Health Service, National Institutes of Health (1991)) was introduced into the 2H7 scFv MTH (SSS) WTCH2CH3 fusion protein (SEQ ID NOS: 4 or 488). The wild type leucine residue was substituted with serine by site-directed mutagenesis using the oligonucleotide Vhser11: 5'-gga ggt ggg agc tct cag gct tat cta cag cag tct ggg gct gag tcg gtg agg cc-3' (SEQ ID NO: 279). The 3'-primer for PCR was huIgG1-3' having the sequence 5'-gtc tct aga cta tca ttt acc cgg aga cag-3' (SEQ ID NO: 280) (XbaI site underlined and italicized). After PCR amplification, the fragments were inserted into the TOPO® cloning vector and sequenced to confirm the presence of the VH11 leucine to serine mutation. The 2H7 scFv-IgG MTH (SSS) WTCH2CH3 encoding DNA was shuttled into the PSL1180 cloning vector (Pharmacia Biotech, Inc., Piscataway, N.J.). The construct PSL1180-2H7 scFv-IgG MTH (SSS) WTCH2CH3 was digested with Sac and XbaI to remove the wild type VH domain and the hinge and CH2 and CH3 domains. The PCR product comprising the VH11 mutant was digested with Sac and XbaI and then inserted into the digested PSL1180 construct according to standard molecular biology procedures. The construct was then digested with Hind III and XbaI, and inserted into the mammalian expression vector pD18 (see methods described in Example 1 and Example 10). The mutant is designated 2H7 scFv VH11SER IgG MTH (SSS) WTCH2CH3 (FIG. 31). Four constructs containing IgA constant region domains were prepared. One construct contained wild type IgA hinge fused to human IgG1 CH2 and CH3 (IgAH IgG WTCH2CH3) (FIG. 31). Sequential PCR amplifications were performed to substitute the human IgG1 hinge of the 2H7 scFv construct with nucleotide sequences encoding the IgA hinge. The 5' oligonucleotide primer (huIgA/Gchim5) for the first PCR reaction had the sequence, 5'-cca tct ccc tca act cca cct acc cca tct ccc tca tgc gca cct gaa ctc ctg-3' (SEQ ID NO: 281). The primer (huIgAhg-5') for the second PCR reaction to add more IgA specific hinge sequence and add a BclI restriction enzyme site (italicized and underlined) had the sequence, 5'-gtt gtt gat cag cca gtt ccc tca act cca cct acc cca tct ccc caa ct-3' (SEQ ID NO: 282). The 3' primer for both amplification steps was huIgG1-3' having the sequence, 5'-gtc tct aga cta tca ttt acc cgg aga cag-3' (SEQ ID NO: 280). The sequence of the PCR product was confirmed by TOPO® cloning as described above. The gel-purified fragment was digested with BclI and XbaI and then inserted into the 2H7 scFv-pD18 vector that had been digested BclI and XbaI to remove all the IgG1 constant region domains. Ligation was performed as described in Example 10 to provide a mammalian expression vector comprising the nucleotide sequence (SEQ ID NO: 283) encoding a 2H7 scFv IgA hinge-IgG1 CH2-CH3 polypeptide (SEQ ID NO: 284).

A second pD18 mammalian expression vector was constructed that had a polynucleotide sequence (SEQ ID NO: 1) that encoded a 2H7 scFv fused to wild type IgA hinge, CH2, and CH3 domains (SEQ ID NO: 285). Human IgA constant regions sequences were obtained by using random primers to reverse transcribe total RNA isolated from human tonsil followed by PCR amplification of the cDNA using sequence specific primers, essentially as described in Example 10. Human IgA hinge-CH2-CH3 nucleotide sequence (SEQ ID NO: 285) encoding the IgA-CH2-CH3 polypeptide (IgAH IgACH2CH3, FIG. 31) (SEQ ID NO: 286) was amplified using the 5' oligonucleotide huIgAhg-5' (SEQ ID NO:(same as above, SEQ ID NO: 281) and a 3' oligonucleotide huIgA3' having the sequence, 5'-gtt gtt tct aga tta tca gta gca ggt gcc gtc cac ctc cgc cat gac aac-3' (SEQ ID NO: 289). Secretion of a 2H7-IgA hinge-IgA CH2-CH3 polypeptide from transfected mammalian cells required co-expression of human J chain that covalently binds to two IgA CH3 domains via disulfide bonds. Total RNA was isolated from tonsil B cells and was reversed transcribed to generate cDNA as described above. PCR amplification of the nucleotide sequence encoding the J chain was performed with J chain specific primers. The 5' PCR primer, HUJCH5nl, had the sequence, 5'-gtt gtt aga tct caa gaa gat gaa agg att gtt ctt-3' (SEQ ID NO: 292), and sequence of the 3' primer, HUJCH3, was 5'-gtt gtt tct aga tta gtc agg ata gca ggc atc tgg-3' (SEQ ID NO: 293). The cDNA was cloned into TOPO® for sequencing as described in Example 10. J chain encoding cDNA (SEQ ID NO: 290) was then inserted into pD18 and pcDNA3-Hygro (+) (Invitrogen Life Technology) vectors for co-transfection with 2H7 scFv IgA hinge-CH2-CH3 constructs. The J chain has the predicted amino acid sequence set forth in SEQ ID NO: 291.

Secretion of an scFv IgA constant region construct in the absence of J chain was accomplished by engineering a truncated CH3 domain with a deletion of the four carboxy terminal amino acids (GTCY, SEQ ID NO: 294) (IgAH IgA-T4, FIG. 31), which include a cysteine residue that forms a disulfide bond with the J chain. The IgA hinge-CH2-CH3 nucleotide sequence containing the deletion in CH3 (SEQ ID NO: 295) was prepared using a 5' PCR primer (huIgAhg-5') having the sequence 5'-gtt gtt gat cag cca gtt ccc tca act cca cct acc cca tct ccc tca act-3' (SEQ ID NO: 310) (BclI site is underlined and italicized), and a 3' PCR primer (HUIGA3T1) having the sequence 5'-gtt gtt tct aga tta tca gtc cac ctc cgc cat gac aac aga cac-3' (SEQ ID NO: 297). This mutated IgA constant region nucleotide sequence was inserted into a 2H7 scFv pD18 vector as described for the generation of the previous 2H7 scFv-Ig constructs (see Example 1 and this example) that comprises the polynucleotide sequence (SEQ ID NO: 298) encoding a 2H7 IgAH IgA-T4 polypeptide (SEQ ID NO: 299).

A fourth construct was prepared that encoded a 2H7 scFv-IgA constant region fusion protein with a deletion of 14 additional amino acids, most of which are hydrophobic residues, from the carboxy terminus of IgA CH3. The 2H7 scFv-IgAH IgA-T4 encoding polynucleotide was used as template to engineer a deletion of the nucleotide sequence encoding PTHVNVSVVMAEVD (SEQ ID NO: 300). The 5' oligonucleotide primer had the sequence 5'-gtt gtt gat cag cca gtt ccc tca act cca cct acc cca tct ccc tca act-3' (SEQ ID NO: 310) (BclI site shown as underlined and italicized). The 3' oligonucleotide sequence was 5'-gtt gtt tct aga tta tca ttt acc cgc caa gcg gtc gat ggt ctt-3' (SEQ ID NO: 301). The deleted IgA CH3 region was amplified by using the above oligonucleotides to amplify the IgA constant region from RNA isolated from human tonsil such that the cDNA contained the deleted carboxyl terminal encoding region for the 18 amino acids. The IgAH IgA-T18 constant region was inserted into a 2H7 scFv pD18 vector that comprises the polynucleotide sequence (SEQ ID NO: 302) encoding a 2H7 IgAH IgA-T18 polynucleotide (SEQ ID NO: 303) as described above.

Example 14

Effector Function of CTLA-4 IgG Fusion Proteins

The Example compares the effector functions of CTLA-4 Ig fusion proteins in CDC and ADCC assays.

Two CTLA-4 IgG fusion proteins were constructed. One fusion protein comprises the extracellular domain of CTLA-4 fused to human IgG1 wild type hinge, CH2, and CH3 domains and is designated CTLA-4 IgG WTH (CCC) WTCH2CH3 (SEQ ID NO: 307). A pD18 mammalian expression vector comprising a polynucleotide sequence encoding CTLA-4 IgG WTH (CCC) WTCH2CH3 (SEQ ID NO: 306) was prepared by fusing in frame the nucleotide sequence encoding the extracellular domain of CTLA-4 (SEQ ID NO: 308) (see U.S. Pat. No. 5,844,095) to the nucleotide sequence encoding IgG WTH (CCC) WTCH2CH3according to the methods described in Examples 1 and 10. The extracellular domain nucleotide sequence also comprises a BclI restriction enzyme site at the 3' end, and a leader peptide nucleotide sequence (SEQ ID NO: 313) that encodes an oncoM leader peptide (SEQ ID NO: 314). A second CTLA-4 IgG fusion protein, designated CTLA-4 IgG MTH (SSS) MTCH2WTCH3, contained the extracellular domain of CTLA-4 (plus the oncoM leader peptide sequence) fused to a mutant IgG hinge in which all three cysteine residues were replaced with serine residues. The hinge region was fused to a mutant IgG1 CH2 domain that had a mutation at isotype position 238 (EU numbering, Ward et al., supra, (position 251 using numbering according to Kabat et al., supra; position 209 where numbering commences with first residue of IgG1 CH1; i.e., PAPELLGGPS (SEQ ID NO: 537) of wild type IgG1 CH2 is modified to PAPELLGGSS (SEQ ID NO: 583), which was fused to IgG1 wild type CH3 (U.S. Pat. No. 5,844,095). The CTLA-4 IgG MTH (SSS) MTCH2WTCH3 polynucleotide comprises the nucleotide sequence in SEQ ID NO: 315 and the deduced amino acid sequence comprises the sequence provided in SEQ ID NO: 316. CTLA-4 fusion proteins were also prepared using CTLA-4 extracellular membrane encoding sequences without the leader peptide (SEQ ID NO: 313 (DNA) and 314 (AA)).

Figure 32:
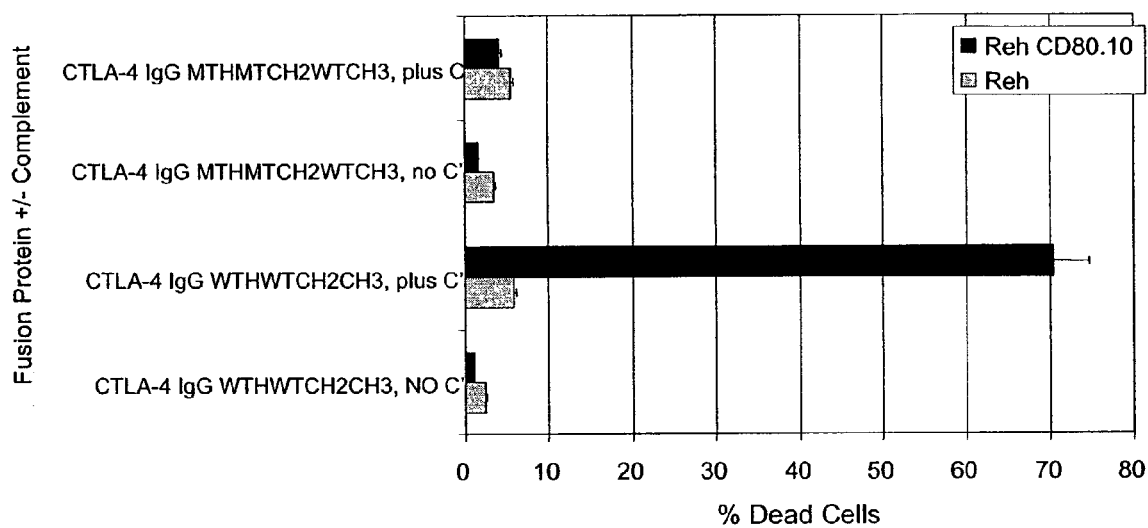
FIG. 32 depicts CDC activity of CTLA-4Ig fusion proteins, CTLA-4 IgG WTH (CCC) WTCH2CH3 (SEQ ID NO: 307) (2 µg/ml) and CTLA-4 IgG MTH MTCH2WTCH3 (SEQ ID NO: 316 and 530) (2 µg/ml), in the presence and absence of rabbit complement (plus C' and no C', respectively). The target cells were Reh cells and Reh cells transfected with CD80 (Reh CD80.10).

To measure CDC activity, purified CTLA-4 IgG WTH (CCC) WTCH2CH3 (2 µg/ml) or CTLA-4 IgG MTH (SSS) MTCH2WTCH3 (2 µg/ml) was added to Reh cells (see Example 12) and to Reh cells transfected with the costimulatory molecule CD80 such that CD80 was expressed on the cell surface (Reh CD80.10, obtained from Dr. E. Clark, University of Washington, Seattle, Wash.; see Doty et al., 1998 *J. Immunol.* 161:2700; Doty et al., 1996 *J. Immunol.* 157:3270), in the presence or absence of rabbit complement (10 µg/ml). Purified CTLA Ig fusion proteins were prepared from culture supernatants of transiently transfected COS cells according to methods described in Example 10. The assays were performed essentially as described in Example 11 and 12. The data presented in FIG. 32 show that only CD80-transfected Reh cells were killed in the presence of complement and CTLA-4 IgG WTH (CCC) WTCH2CH3 fusion protein.

Figure 33:
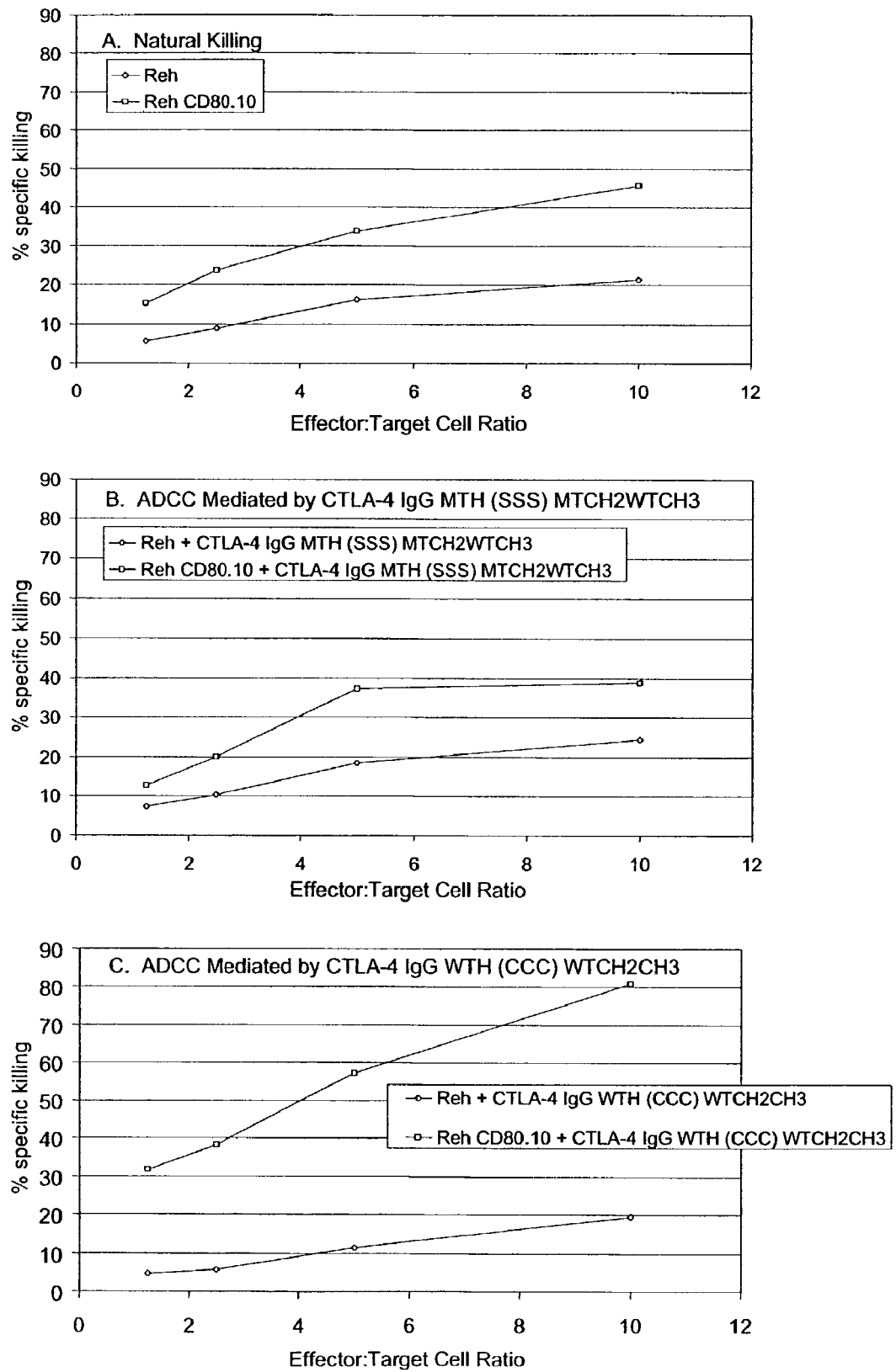
FIG. 33 shows ADCC activity of CTLA-4 Ig fusion proteins, CTLA-4 IgG WTH (CCC) WTCH2CH3 (SEQ ID NO: 307) (2 µg/ml) and CTLA-4 IgG MTH MTCH2WTCH3 (SEQ ID NO: 316 and 530) (2 mg/ml). Effector cells, human PBMC, were added to target cells, Reh or Reh CD80.1, at the ratios indicated.

The purified CTLA-4 Ig fusion proteins were also tested in ADCC assays. Human PBMC, serving as effector cells, were added to Reh or Reh CD80.1 target cells at a ratio of 1.25:1, 2.5:1, 5.0:1, and 10:1. Cells were labeled and the assays performed essentially as described in Examples 11 and 12. The results are presented in FIG. 33. Each data point represents the average of four independent culture wells at each effector:target cell ratio. The data show that only CTLA-4 IgG WTH (CCC) WTCH2CH3 mediated significant ADCC of Reh CD80.10 cells.

Example 15

Effector Function of CTLA-4 IgA Fusion Proteins

CTLA-4 IgA fusion proteins are prepared as described for the IgG fusion proteins (see Examples 1, 13, and 14). CTLA-4 extracellular domain nucleotide sequence (SEQ ID NO: 313) is fused in open reading frame to nucleotides encoding IgAH IgACH2CH3 (SEQ ID NO: 287) to provide the nucleotide sequence (SEQ ID NO: 319) encoding a CTLA-4 IgAH IgACH2CH3 fusion protein (SEQ ID NO: 320). The fusion protein is transiently expressed in COS cells (see Example 10) or stably expressed in CHO cells (see Example 1). Secretion of the CTLA-4 IgAH IgACH2CH3 fusion protein requires co-transfection with a construct containing a polynucleotide sequence (SEQ ID NO: 290) that encodes human J chain (SEQ ID NO: 291). The CTLA-4 IgAH IgACH2CH3 fusion protein is isolated as described in Examples 10 and 14. To express a CTLA-4 IgA construct without the presence of J chain, a CTLA-4 IgAH IgA-T4 construct is prepared and transfected into mammalian cells. In a similar manner as described for the CTLA-4 extracellular fragment fused to wild type IgA hinge-CH2CH3, the CTLA-4 extracellular domain nucleotide sequence (SEQ ID NO: 308) is fused in open reading frame to a nucleotide sequence (SEQ ID NO: 295) encoding a IgAH IgA-T4 polypeptide (SEQ ID NO: 296) to provide a nucleotide sequence comprising SEQ ID NO: 319 encoding a CTLA-4 IgAH IgA-T4 polypeptide (SEQ ID NO: 320). Effector function of each construct is evaluated by CDC and ADCC as described in Example 14.

Example 16

Binding of Anti-CD20 scFv Human Ig Fusion Proteins to CHO Cells Expressing CD20

Figure 34:
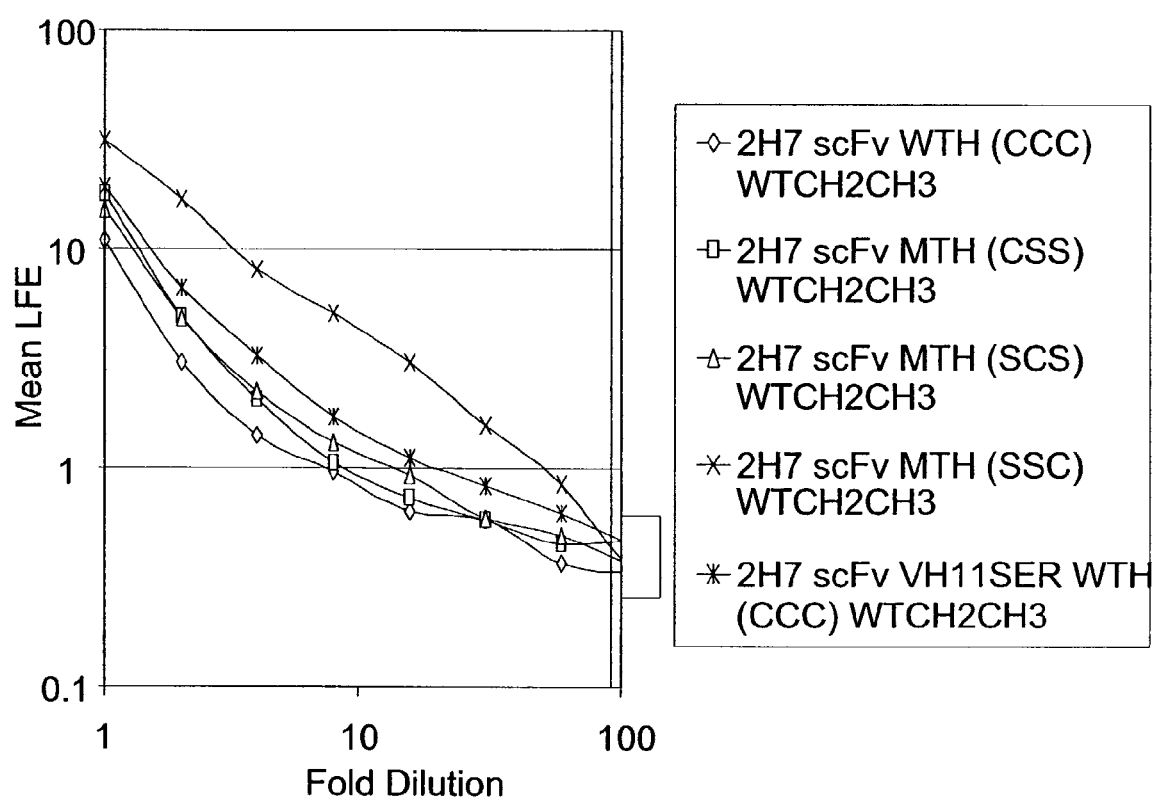
FIG. 34 illustrates binding of 2H7 (anti-CD20) scFv Ig fusion proteins to (CD20+) CHO cells by flow immunocytofluorimetry.

This Example describes binding of 2H7 scFv Ig fusion proteins to CHO cells that express CD20. The analysis was performed by flow cytometry. Culture supernatants were collected from transiently transfected COS cells expressing 2H7 scFv IgG WTH (CCC) WTCH2CH3 (SEQ ID NOS: 2, 15; 239, 240; 458, 459); 2H7 scFv IgG MTH (CSS) WTCH2CH3 (SEQ ID NO: 582); 2H7 scFv IgG MTH (SCS) WTCH2CH3 (SEQ ID NO: 584); and 2H7 scFv VHSER11 WTH WTCH2CH3, and two-fold serial dilutions were prepared. Serial two-fold dilutions of purified 2H7 scFv IgG MTH (SSC) WTCH2CH3 (SEQ ID NOS: 585, 586) were prepared starting at a concentration of 5 µg/ml. The culture supernatants and purified fusion protein samples were incubated with (CD20+) CHO cells for one hour on ice. The cells were washed twice and then incubated with 1:100 FITC-conjugated goat anti-human IgG (CalTag) for 40 minutes. The unbound conjugate was then removed by washing the cells and flow cytometry analysis was performed using a Coulter Epics XL cell sorter. Results are presented in FIG. 34.

Example 17

Immunoblot Analysis of Anti-CD20 scFv Human IgG And IgA Fusion Proteins

This Example describes immunoblot analysis of 2H7 scFv IgG and 2H7 scFv IgA fusion proteins that were immunoprecipitated from transfected cell culture supernants.

Figure 35:
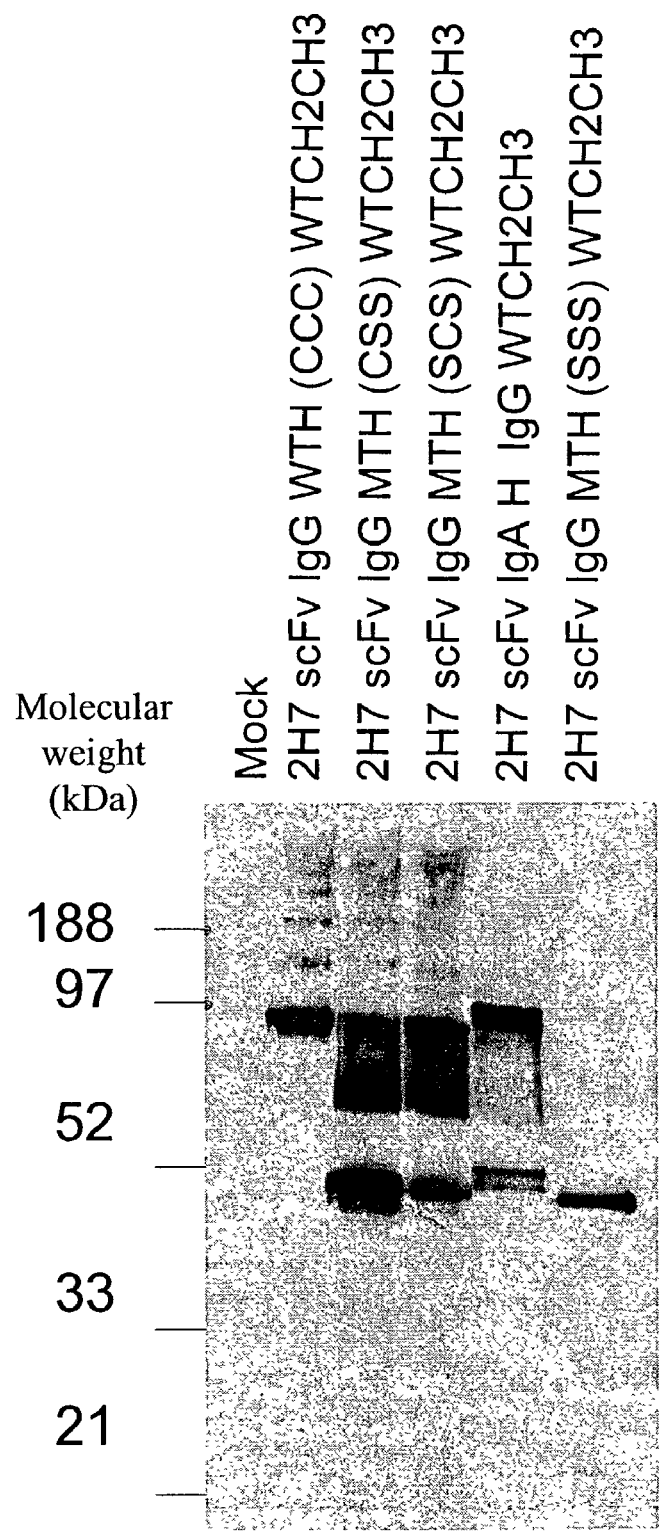
FIG. 35 presents an immunoblot of 2H7 scFv IgG and IgA fusion proteins. COS cells were transiently transfected with various 2H7 scFv Ig fusion protein constructs. The expressed polypeptides were immune precipitated with protein A, separated in a non-reducing SDS polyacrylamide gel, and then transferred to a polyvinyl fluoride membrane. Proteins were detected using an anti-human IgG (Fc specific) horseradish peroxidase conjugate. Lane 1: vector only; lane 2: 2H7 scFv IgG WTH (CCC) WTCH2CH3 (SEQ ID NO: 15 and 240); lane 3: 2H7 scFv IgG MTH (CSS) WTCH2CH3 (SEQ ID NO: 670); lane 4: 2H7 scFv IgG MTH (SCS) WTCH2CH3 (SEQ ID NO: 671); lane 5: 2H7 scFv IgAH IgG WTCH2CH3 (SEQ ID NO: 18 and 284); and lane 6: 2H7 scFv IgG MTH (SSS) WTCH2CH3 (SEQ ID NO: 17, 274 and 489).

COS cells were transiently transfected with plasmids comprising nucleotide sequences for 2H7 scFv IgG WTH (CCC) WTCH2CH3 (SEQ ID NO: 458); 2H7 scFv IgG MTH (CSS) WTCH2CH3 (SEQ ID NO: 581); 2H7 scFv IgG MTH (SCS) WTCH2CH3 (SEQ ID NO: 583); 2H7 scFv IgA H IgG WTCH2CH3 (SEQ ID NOS: 283, 499); and scFv IgG MTH (SSS) WTCH2CH3 (SEQ ID NOS: 273, 488) essentially according to the method described in Example 10. Cells were also transfected with vector only. After 48-72 hours at 37° C., cell culture supernatants were harvested and combined with protein A-agarose beads (Repligen) for one hour at 4° C. The beads were centrifuged and washed several times in TNEN [20 mM Tris base, 100 mM NaCl, 1 mM EDTA, and 0.05% NP-40, pH 8.0). The immunoprecipitates were combined with 25 µl 2× NuPAGE® SDS Sample Buffer (Invitrogen Life Technologies) (non-reduced samples). The proteins were fractionated on NuPAGE® 10% Bis-Tris gels (Invitrogen Life Technologies). After electrophoresis (approximately 1 hour), the proteins were transferred from the gel onto a Immobilon P polyvinylidene fluoride (PVDF) membrane (Millipore, Bedford, Mass.) using a semi-dry blotter (Ellard Instrumentation, Monroe, Wash.). The PVDF membrane was blocked in PBS containing 5% nonfat milk and then probed with HRP-conjugated goat anti-human IgG (Fc specific) (CalTag). After washing the immunoblot several times in PBS, the blot was developed using ECL (Amersham Biosciences). The results are shown in FIG. 35.

Example 18

Binding of Anti-CD20 scFv Human IgA Fusion Proteins to CD20+ CHO Cells

This Example describes flow immunocytofluorimetry analysis of binding of 2H7 scFv IgAH IgACH2CH3 (SEQ ID NOS: 286, 502) and 2H7 scFv IgAH IgAT4 (SEQ ID NOS: 299, 515) fusion proteins to (CD20+) CHO cells.

Figure 36:
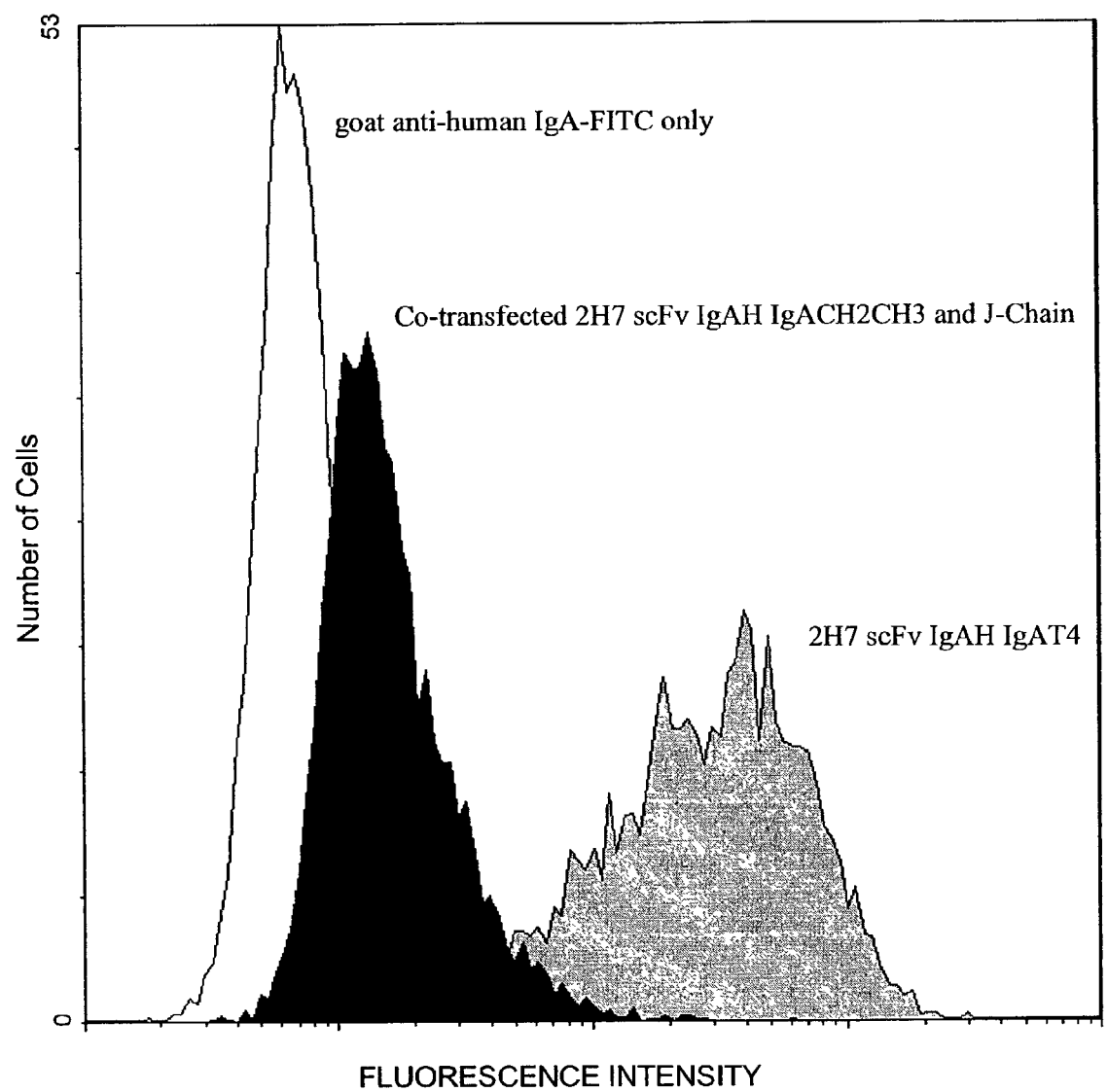
FIG. 36 illustrates binding of 2H7 scFv IgAH IgACH2CH3 polypeptide (SEQ ID NO: 286 and 502) and 2H7 scFv IgAH IgAT4 (SEQ ID NO: 299) to (CD20+) CHO cells by flow immunocytofluorimetry. The source of the polypeptides was culture supernatants from transiently transfected COS cells. COS cells transfected with a plasmid comprising a sequence encoding 2H7 scFv IgAH IgACH2CH3 were co-transfected with a plasmid containing nucleotide sequence encoding human J chain.

COS cells were transiently co-transfected as described in Example 10 with plasmid DNA comprising a polynucleotide sequence (SEQ ID NO: 285) encoding 2H7 scFv IgAH IgACH2CH3 polypeptide (SEQ ID NO: 501) and with a separate plasmid comprising a polynucleotide sequence (SEQ ID NO: 290) encoding a human J chain polypeptide (SEQ ID NO: 291). COS cells were also transfected with a polynucleotide sequence (SEQ ID NOS: 298, 514) encoding a 2H7 scFv IgA fusion protein that had a deletion of four amino acids at the carboxy terminus of CH3 (2H7 scFv IgAH SEQ ID NOS: 299, 515). The transfections were performed as described in Example 10. Culture supernatants from transfected COS cells were combined with (CD20+) CHO cells (see Example 1) and incubated for one hour on ice. The cells were washed twice with PBS-2% FBS and then combined with FITC-conjugated goat anti-human IgA chain (CalTag) (1:100) for 40 minutes. The cells were again washed and then analyzed by flow cytometry using a Coulter Epics XL cell sorter. FIG. 36 shows that co-transfection with J chain was not required for secretion of 2H7 scFv IgAH IgAT4, the 2H7 IgA fusion protein with the truncated CH3 carboxy end (SEQ ID NO: 299, 515).

Example 19

Effector Function of Anti-CD20 scFv Human IgA Fusion Proteins

Figure 37:
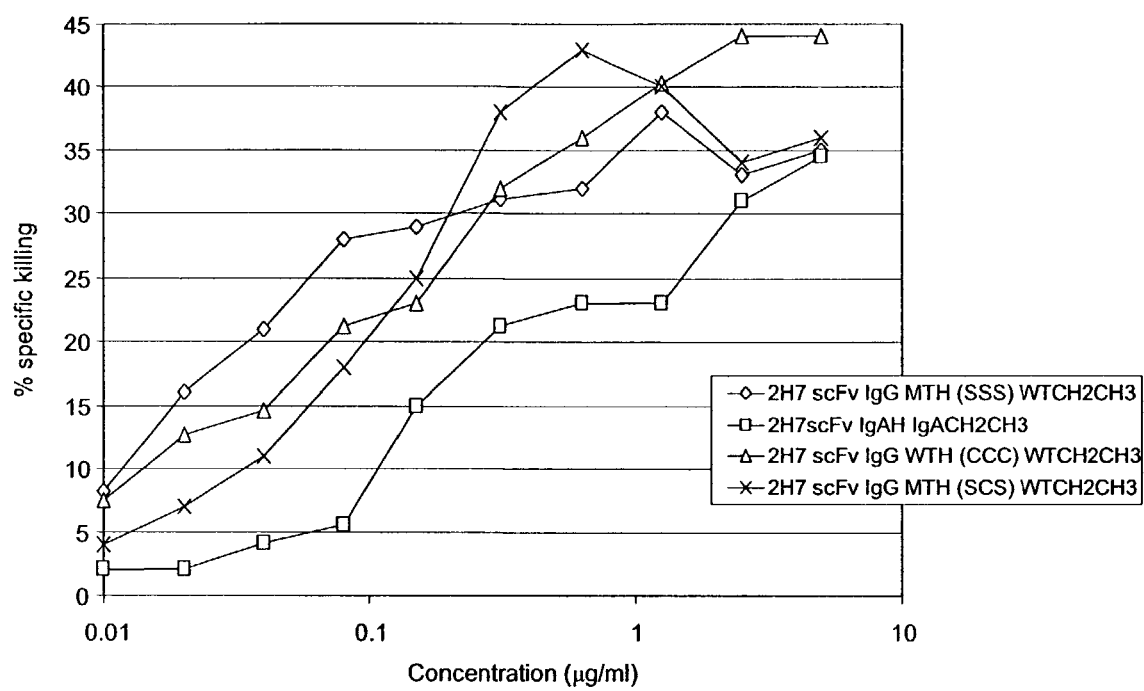
FIG. 37 illustrates ADCC activity of anti-CD20 (2H7) scFv Ig fusion proteins against BJAB target cells using whole blood as the source of effector cells. Purified 2H7 scFv Ig fusion proteins were titrated and combined with $^{51}$Cr-labeled BJAB cells (5×10$^4$) and whole blood (1:4 final dilution). Each data point represents the average percent specific killing measured in four sample wells.

This Example illustrates ADCC activity of 2H7 IgG and IgA fusion proteins against cells that express CD20. BJAB cells were prelabeled with $^{51}$Cr (100 µCi) (Amersham) for two hours at 37° C. Effector cells were obtained from fresh, resting human whole blood, which was diluted in an equal volume of Alsever's solution to prevent coagulation. 2H7 scFv IgG MTH (SSS) WTCH2CH3 (SEQ ID NO: 489); 2H7 scFv IgG MTH (SCS) WTCH2CH3 (SEQ ID NO: 586); 2H7 scFv IgG WTH (CCC) WTCH2CH3 (SEQ ID NO: 459); and 2H7 scFv IgAH IgACH2CH3 (SEQ ID NO: 299, 515) fusion proteins were purified from transiently transfected COS cell supernatants (100-200 ml) by protein A chromatography as described in Example 10. COS cells transfected with the plasmid encoding 2H7 scFv IgAH IgACH2CH3 were co-transfected with a plasmid encoding human J chain as described in Example 18. Two-fold serial dilutions of the purified 2H7 Ig fusion proteins starting at 5 µg/ml were added to the labeled BJAB cells (5×10$^4$ cells per well of 96 well tissue culture plate) in the presence of whole blood (100 µl of whole blood diluted 1:1 in Alsever's solution, final dilution 1:4) and incubated for five hours at 37° C. Culture supernatants were harvested and analyzed as described in Example 11. Percent specific killing was calculated according to the following equation: ((experiment release minus spontaneous release)/(maximum release minus spontaneous release))× 100. The data are presented in FIG. 37. Each data point represents the average of quadruplicate samples.

In a second ADCC assay, the number of labeled BJAB target cells was held constant in each sample, and whole blood was added at dilutions of 0.25, 0.125, and 0.0625. Purified 2H7 IgG and IgA fusion proteins were added at a concentration of 5 µg/ml. The BJAB cells, whole blood, and fusion proteins were incubated, the supernatants harvested, and the percent specific killing was calculated as described above. Percent specific killing for each of the 2H7 fusion proteins is presented in FIG. 38.

Figure 38:
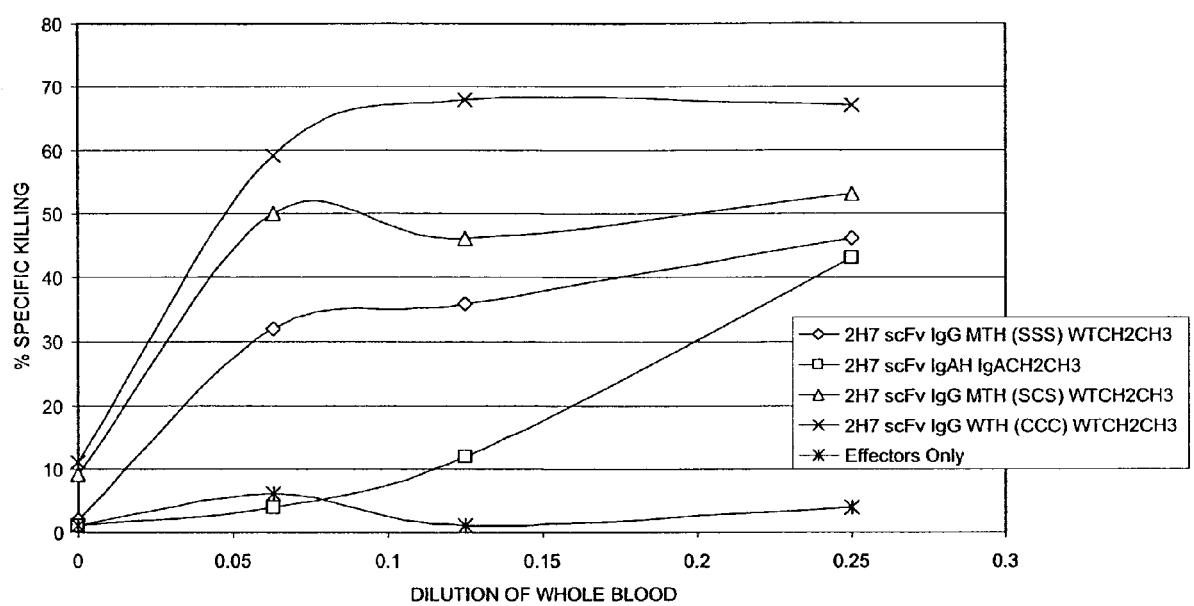
FIG. 38 demonstrates ADCC activity of 2H7 scFv Ig fusion proteins (5 µg/ml) against $^{51}$Cr-labeled BJAB cells at 0.25, 0.125, and 0.625 dilutions of whole blood. Each data point represents the average percent specific killing measured in four sample wells.
Figure 39A:
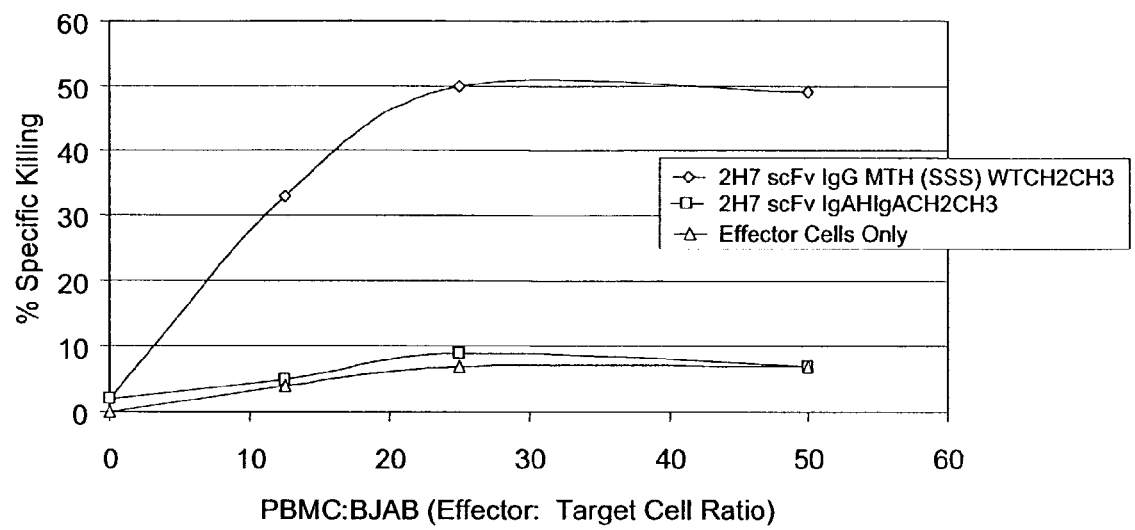
FIG. 39 shows a comparison of ADCC activity of 2H7 scFv IgG MTH (SSS) WTCH2CH3 (5 µg/ml) and 2H7 scFv IgAH IgACH2CH3 (5 µg/ml) when human PBMC are the source of effector cells (FIG. 39A) and when human whole blood is the source of effector cells (FIG. 39B).
Figure 39B:
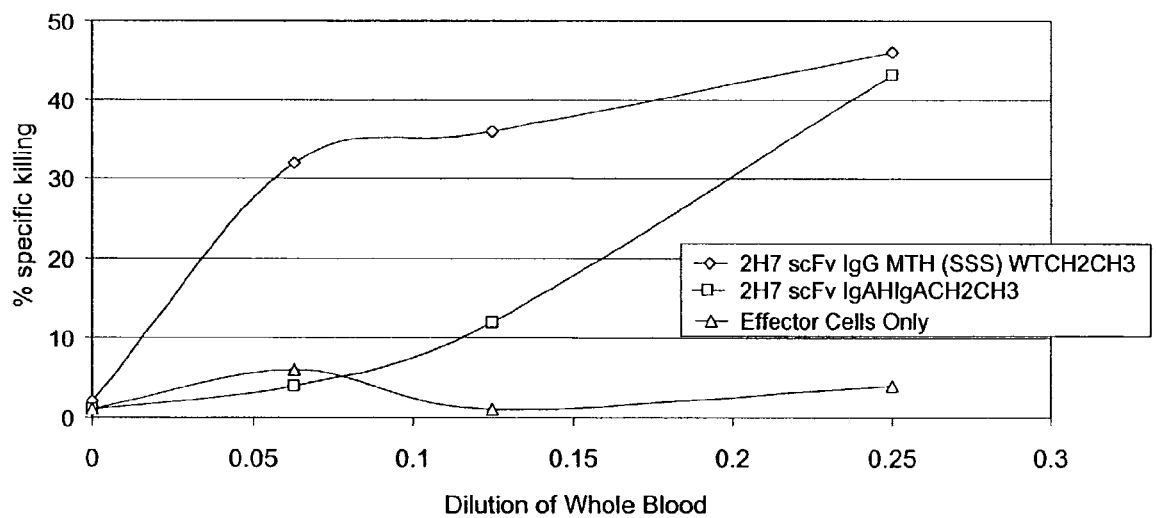

The ADCC activity of purified 2H7 scFv IgG MTH (SSS) WTCH2CH3 (5 µg/ml) and of purified 2H7 scFv IgAH IgACH2CH3 (5 µg/ml) was compared in the presence of different effector cell populations. PBMC were isolated from whole blood as described in Examples 11 and 12. PBMC were combined with labeled BJAB target cells (5×10$^4$ per well of 96 well tissue culture plate) at ratios of 50:1, 25:1, and 12.5:1. The assay was performed and the data analyzed as described above. FIG. 39A shows that only the 2H7 scFv IgG MTH (SSS) WTCH2CH3 fusion protein had ADCC activity when PBMC served as the effector cells. FIG. 39B shows that both 2H7 scFv IgG MTH (SSS) WTCH2CH3 and 2H7 scFv IgAH IgACH2CH3 exhibit ADCC activity when whole blood was the source of effector cells (as illustrated in FIG. 38).

Example 20

Expression Level of 2H7 scFv VH11Ser IgG MTH (SSS) WTCH2CH3 Fusion Protein

Figure 40:
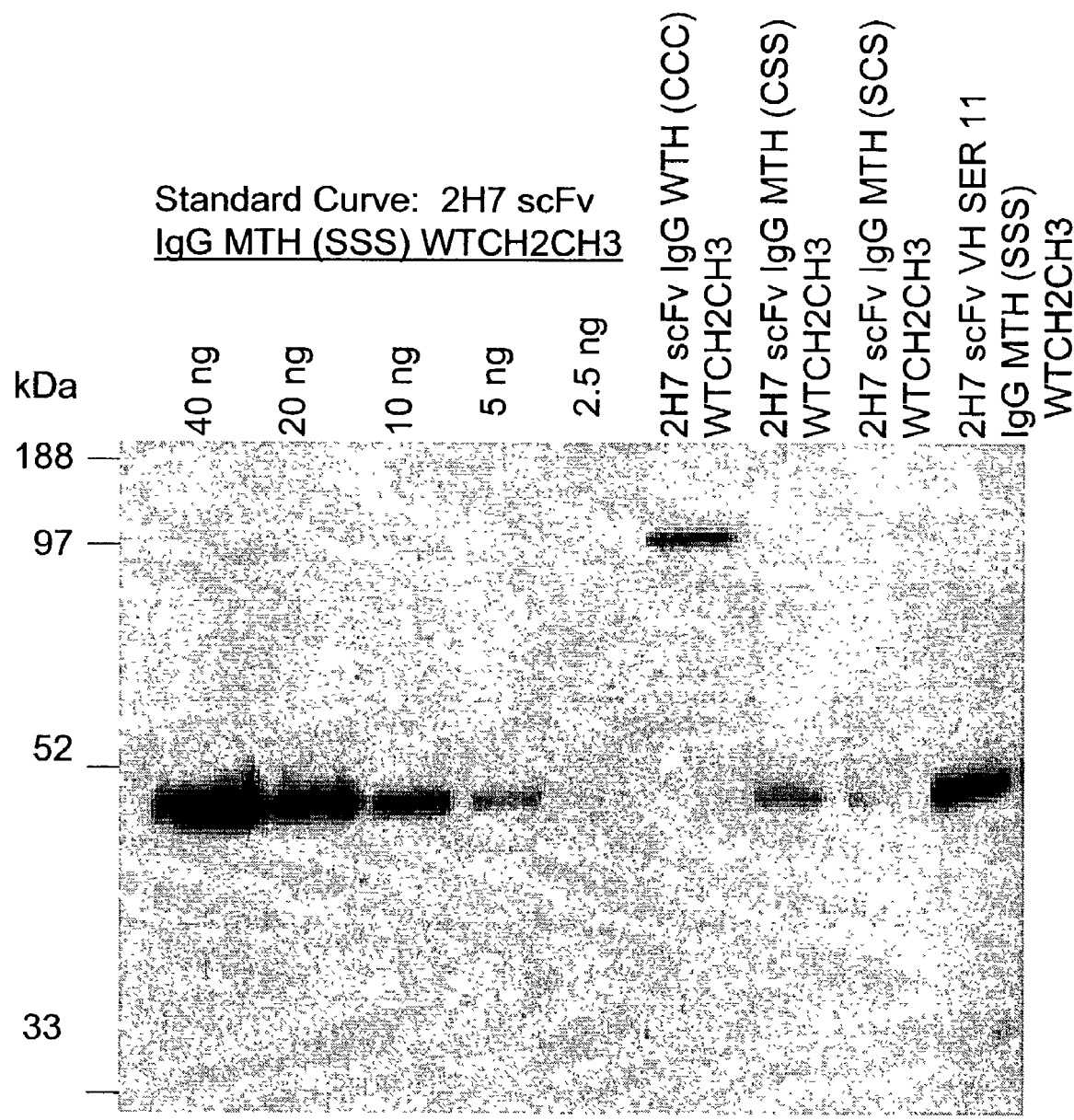
FIG. 40 presents an immunoblot of 2H7 scFv IgG fusion proteins. COS cells were transiently transfected with various 2H7 scFv Ig fusion protein constructs. Culture supernatants containing the expressed polypeptides were separated in a non-reducing SDS polyacrylamide gel, and then were transferred to a polyvinyl fluoride membrane. Proteins were detected using an anti-human IgG (Fc specific) horseradish peroxidase conjugate. Lanes 1-5: purified 2H7 scFv IgG MTH (SSS) WTCH2CH3 at 40 ng, 20 ng, 10 ng/5 ng, and 2.5 ng per lane, respectively. Culture supernatants were separated in lanes 6-9. Lane 6: 2H7 scFv IgG WTH (CCC) WTCH2CH3; lane 7: 2H7 scFv IgG MTH (CSS) WTCH2CH3; lane 8: 2H7 scFv IgG MTH (SCS) WTCH2CH3; and lane 9: 2H7 scFv VHSER11 IgG MTH (SSS) WTCH2CH3. The molecular weight (kDal) of marker proteins is indicated on the left side of the immunoblot.

This Example compares the expression level of 2H7 scFv VH11Ser IgG MTH (SSS) WTCH2CH3 fusion protein (SEQ ID NO: 488) with other 2H7 scFv IgG constructs that do not contain the mutation in the variable heavy chain domain. The mammalian expression vector pD18 comprising nucleotide sequences 2H7 scFv IgG MTH (SSS) WTCH2CH3 (SEQ ID NO: 488); 2H7 scFv IgG MTH (CSS) WTCH2CH3 (SEQ ID NO 581); 2H7 scFv IgG MTH (SCS) WTCH2CH3 (SEQ ID NO: 583); 2H7 scFv IgG WTH (CCC) WTCH2CH3 (SEQ ID NO: 458); and 2H7 scFv VHSER11 IgG MTH (SSS) WTCH2CH3 (see Examples 1 and 13) were transiently transfected into COS cells as described in Example 10. After 72 hours at 37° C., culture supernatants were harvested, and 1 µl of each supernatant was combined with non-reducing sample buffer (see method described in Example 10). The culture supernatant samples and aliquots of purified 2H7 scFv IgG MTH (SSS) WTCH2CH3 (40 ng, 20 ng, 10 ng/5 ng, and 2.5 ng) were fractionated on 10% Bis-Tris (MOPS) NUPAGE® gels (Invitrogen Life Technologies). MULTIMARK® protein standards (Invitrogen Life Technologies) were also separated on the gel. The proteins were transferred to a PDVF membrane and immunoblotted as described in Example 17. The immunoblot is presented in FIG. 40. The amounts of the fusion proteins were quantified by densitometry analysis of the blots using the ScionImage for Windows software and comparison with the standard curve. The 2H7 scFv IgG WTH (CCC) WTCH2CH3 construct produced approximately 12 ng/ul or 12 micrograms/ml, the 2H7 scFv IgG MTH (CSS) WTCH2CH3 produced approximately 10 ng/ul or 10 micrograms/ml, the 2H7 scFv IgG MTH (SCS) WTCH2CH3 construct produced approximately 1 ng/ul or 1 microgram/ml, and the 2H7 scFv VHSER11 IgG MTH (SSS) WTCH2CH3 construct produced approximately 30 ng/ml or 30 micrograms/ml.

Example 21

Construction of a 2H7 scFv IgG Fusion Protein with a Mutant CH3 Domain

Amino acid mutations were introduced into the CH3 domain of a 2H7 IgG fusion protein. The pD18 vector comprising 2H7 scFv IgG MTH (SSS) WTCH2CH3 (SEQ ID NO: 488) was digested with BclI and XbaI to remove the MTH WTCH2CH3 (SEQ ID NO: 6) fragment, which was then subcloned into pShuttle vector (BD Biosciences Clontech, Palo Alto, Calif.) that was double-digested with BclI and XbaI. Subcloning was performed in a kanamycin resistant vector because the ampicillin resistance gene has an XmnI site, which is required for this cloning procedure. Five constructs were prepared with the following substitutions: (1) a phenylalanine residue at position 405 (numbering according to Kabat et al. supra) was substituted with tyrosine using the oligonucleotide CH3Y405; (2) the phenylalanine position at 405 was substituted with an alanine residue using the oligonucleotide CH3A405; (3) the tyrosine residue at position 407 was substituted with an alanine using the oligonucleotide CH3A407; (4) both wild type amino acids at positions 405 and 407 were substituted with tyrosine and alanine, respectively using the oligonucleotide CH3Y405A407; and (5) both wild type amino acids at positions 405 and 407 were substituted with alanine using the oligonucleotide CH3A405A407. The oligonucleotides were the 3' primers for PCR amplification of a portion of the CH3 domain. The nucleotide sequences for each 3' oligonucleotide were as follows.

```
CH3Y405:      5'-gtt gtt gaa gac gtt ccc ctg ctg cca cct gct ctt gtc cac ggt gag ctt gct    (SEQ ID NO:
                                                                                              365)
              gta gag gta gaa gga gcc-3'

CH3A405:      5'-gtt gtt gaa gac gtt ccc ctg ctg cca cct gct ctt gtc cac ggt gag ctt gct    (SEQ ID NO:
                                                                                              366)
              gta gag ggc gaa gga gcc-3'

CH3A407:      5'-gtt gtt gaa gac gtt ccc ctg ctg cca cct gct ctt gtc cac ggt gag ctt gct    (SEQ ID NO:
                                                                                              367)
              ggc gag gaa gaa gga gcc-3'

CH3Y405A407:  5'-gtt gtt gaa gac gtt ccc ctg ctg cca cct gct ctt gtc cac ggt gag             (SEQ ID NO:
                                                                                              368)
              ctt gct ggc gag gta gaa gga gcc-3'

CH3A405A407:  5'-gtt gtt gaa gac gtt ccc ctg ctg cca cct gct ctt gtc cac ggt gag             (SEQ ID NO:
                                                                                              369)
              ctt gct ggc gag ggc gaa gga gcc-3'
```

The template was the mutant hinge MHWTCH2CH3 human IgG1. The 5' PCR oligonucleotide primer was huIgGMHWC, (SEQ ID NO: 332). The amplified products were TOPO® cloned and sequenced as described in Examples 1 and 10. DNA from the clones with the correct sequence was digested with BclI and XmnI and transferred to pShuttle containing the MTH WTCH2CH3 sequence, which was also digested with the same restriction enzymes. The mutated IgG sequences were then removed by digestion with BclI and XbaI and inserted into a pD18 vector containing 2H7 scFv that was also digested with BclI and XbaI. The polynucleotide sequences for mutated the CH3 domains, MTCH3 Y405, MTCH3 A405, MTCH3 A407, MTCH3 Y405A407, and MTCH3 A405A407 are shown in SEQ ID NOs: 370, 371, 372, 373, 374, respectively, and the polypeptide sequences for each are shown in SEQ ID NOs: 375, 376, 377, 378, 379 respectively. The polynucleotide sequences for the 2H7 scFv MTH WTCH2 MTCH3 Y405, 2H7 scFv MTH WTCH2 MTCH3 A405, scFv MTH WTCH2 MTCH3 A407, scFv MTH WTCH2 MTCH3 Y405A407, and scFv MTH WTCH2 MTCH3 A405A407 are shown in SEQ ID NOs: 381, 380, 383, 384, 382, respectively, and the deduced amino acid sequences are shown in SEQ ID NOs: 386, 385, 387, 388 389, respectively.

Example 22

Construction of 2H7 scFv IgG Fusion Proteins with Hinge Mutations

A 2H7 scFv IgG fusion protein was constructed with the third cysteine residue in the IgG1 hinge region substituted with a serine residue. The template for introduction of the mutations was a polynucleotide encoding 2H7 scFv WTH WTCH2CH3 (SEQ ID NO: 2, 239). The oligonucleotide introducing the mutations was a 5' PCR primer oligonucleotide HIgGMHcys3 having the sequence 5'-gtt gtt gat cag gag ccc aaa tct tgt gac aaa act cac aca tgt cca ccg tcc cca gca cct-3' (SEQ ID NO: 589). The oligonucleotide introducing the mutation into the hinge region was combined with template and a 3' oligonucleotide containing an XbaI site (underlined and italicized) (5'-gtt gtt tct aga tca ttt acc cgg aga cag gga gag gct ctt ctg cgt gta g-3' (SEQ ID NO: 278)) to amplify the mutant hinge-wild type (WT)-CH2-CH3 sequences by PCR. The IgG MTH CCS mutant sequence was amplified for 30 cycles with a denaturation profile of 94° C., annealing at 50° C. for 30 seconds, and extension at 72° C. for 30 seconds. The amplified polynucleotides were inserted into the TOPO® cloning vector (Invitrogen Life Technologies) and then were sequenced as described in Example 1 to confirm the presence of the mutation. pD18 vector containing 2H7 scFv was digested to remove the constant region sequences essentially as described in Example 10. The mutant hinge-wild type CH2-CH3 regions were inserted in frame into the digested vector DNA to obtain vectors comprising 2H7 scFv MTH (CCS) WTCH2CH3 encoding DNA (SEQ ID NO: 395). The deduced polypeptide sequence is shown in SEQ ID NO: 398.

Example 23

Construction of Anti-CD20 IgE Fusion Proteins

A binding domain is fused to IgE constant region sequences such that the expressed polypeptide is capable of inducing an allergic response mechanism. The single chain Fv nucleotide sequence of 40.2.220 (SEQ ID NO: 466), an anti-CD40 antibody, is fused to IgE CH2-CH3-CH4 according to methods described for other scFv immunoglobulin constant region constructs (see Examples 1, 5, 10, and 13). To PCR amplify the IgE CH2-CH3-CH4 domains, a 5' oligonucleotide primer, hIgE5Bc1, having the sequence 5'-gtt gtt gat cac gtc tgc tcc agg gac ttc acc cc-3', and a 3' oligonucleotide primer, hIgE3stop, having the sequence 5'-gtt gtt tct aga tta act ttt acc ggg att tac aga cac cgc tcg ctg g-3' are used.

The retroviral transfection system for ectopic surface expression of genetically engineered cell surface receptors composed of scFvs that bind costimulatory receptors described in Example 12 is used to construct a 40.2.220 scFv IgE-CD80 fusion protein. The 40.2.220 scFv IgE fusion polynucleotide sequence is fused in frame to sequences encoding the transmembrane domain and cytoplasmic tail of human CD80 (SEQ ID NO: 460), such that when the fusion protein is expressed in the transfected cell, CD80 provided an anchor for surface expression of the scFv Ig fusion protein. cDNA encoding the anti-CD40 scFv-IgE-CD80 fusion proteins is inserted into the retroviral vector pLNCX (BD Biosciences Clontech) according to standard molecular biology procedures and vendor instructions. The 40.2.220 scFv-Ig-CD80 cDNA is inserted between the 5'LTR-neomycin resistance gene-CMV promoter sequences and the 3'LTR sequence. The retroviral constructs are transfected into a carcinoma cell line, and transfected cells are screened to select clones that are expressing the 40.2.220 scFv-Ig-CD80 fusion protein on the cell surface.

Example 24

Construction of IgA-T4 Mutants that are Expressed on the Cell Surface

The retroviral transfection system for ectopic surface expression of genetically engineered cell surface receptors composed of scFvs that bind costimulatory receptors described in Example 12 is used to construct a 2H7 scFv IgA hinge IgA-T4-CD80 fusion protein. The 2H7 scFv IgAH IgA-T4 fusion polynucleotide sequence (SEQ ID NO: 298) is fused in frame to sequences encoding the transmembrane domain and cytoplasmic tail of human CD80 (SEQ ID NO: 460), such that when the fusion protein is expressed in the transfected cell, CD80 provided an anchor for surface expression of the scFv Ig fusion protein. cDNA encoding the 2H7 scFv IgAH IgA-T4-CD80 fusion protein (SEQ ID NO: 299) is inserted into the retroviral vector pLNCX (BD Biosciences Clontech) according to standard molecular biology procedures and vendor instructions. The 2H7 scFv IgAH IgA-T4-CD80 cDNA is inserted between the 5'LTR-neomycin resistance gene-CMV promoter sequences and the 3'LTR sequence. The retroviral construct is transfected into Reh, an acute lymphocytic leukemia cell line (ATCC CRL-8286). Transfected cells are screened to select clones that are expressing 2H7 scFv-Ig fusion proteins on the cell surface.

Example 25

Characterization of an Anti-4-1BB scFv Ig-CD80 Fusion Protein Expressed on the Cell Surface of Tumor Cells and Growth of the Tumor Cells In Vivo This example describes construction of an anti-murine 4-1BB (CD137) scFv fusion protein that has an IgG wild type hinge and CH2 and CH3 domains that is fused to the CD80 transmembrane and cytoplasmic domains. The Example also illustrates the effect of the cell surface expression of the anti-4-1BB scFv IgG CD80 polypeptide when the transfected tumor cells are transplanted into mice.

The heavy and light chain variable regions of a rat anti-4-1BB (CD137) monoclonal antibody (1D8) were cloned, and a single chain Fv construct was prepared essentially as described in Example 1. The heavy chain and light chain variable regions of each antibody were cloned according to standard methods for cloning immunoglobulin genes and as described in Example 1. A single chain Fv construct was prepared as described in Example 1 by inserting a nucleotide sequence encoding a (gly$_4$ser)$_3$ peptide linker between the VL region nucleotide sequence of 1D8 (SEQ ID NOS: 336, 549) and the VH region nucleotide sequence of 1D8 (SEQ ID NOS: 333, 547). The polypeptide sequence for 1D8 VL is shown in SEQ ID NOS: 342, 550, and the polypeptide sequence for the VH domain is shown in SEQ ID NOS: 341, 548. The scFv polynucleotide (SEQ ID NO: 337) was then fused to human IgG1 wild-type hinge-CH2-CH3 domains according to the methods described in Example 1. The scFv IgG1 fusion polynucleotide sequence was then fused in frame to sequences encoding the transmembrane domain and cytoplasmic tail of human CD80 (SEQ ID NO: 460) essentially as described in Example 12, such that when the fusion protein was expressed in the transfected cell, CD80 provided an anchor for surface expression of the scFv Ig fusion protein. cDNA encoding the scFv-IgG-CD80 fusion protein (SEQ ID NO: 340) was inserted into the retroviral vector pLNCX (BD Biosciences Clontech) according to standard molecular biology procedures and vendor instructions. The scFv-Ig-CD80 cDNA was inserted between the 5'LTR-neomycin resistance gene-CMV promoter sequences and the 3'LTR sequence.

The retroviral constructs were transfected into the metastatic M2 clone of K1735, a melanoma cell line, provided by Dr. I. Hellstrom, PNR1, Seattle, Wash. Transfected cells were screened to select clones that were expressing scFv-Ig fusion proteins on the cell surface. To demonstrate that the 1D8 scFv IgG-CD80 construct was expressed on the cell surface of the tumor cells, the transfected cells were analyzed by flow immunocytofluorimetry. Transfected cells (K1735-1D8) were incubated for one hour on ice in phycoerythrin-conjugated F(ab')$_2$ goat anti-human IgG. The unbound conjugate was then removed by washing the cells and flow cytometry analysis was performed using a Coulter Epics XL cell sorter. Results are presented in FIG. 41A.

Figures 41A, 41B, 41C:
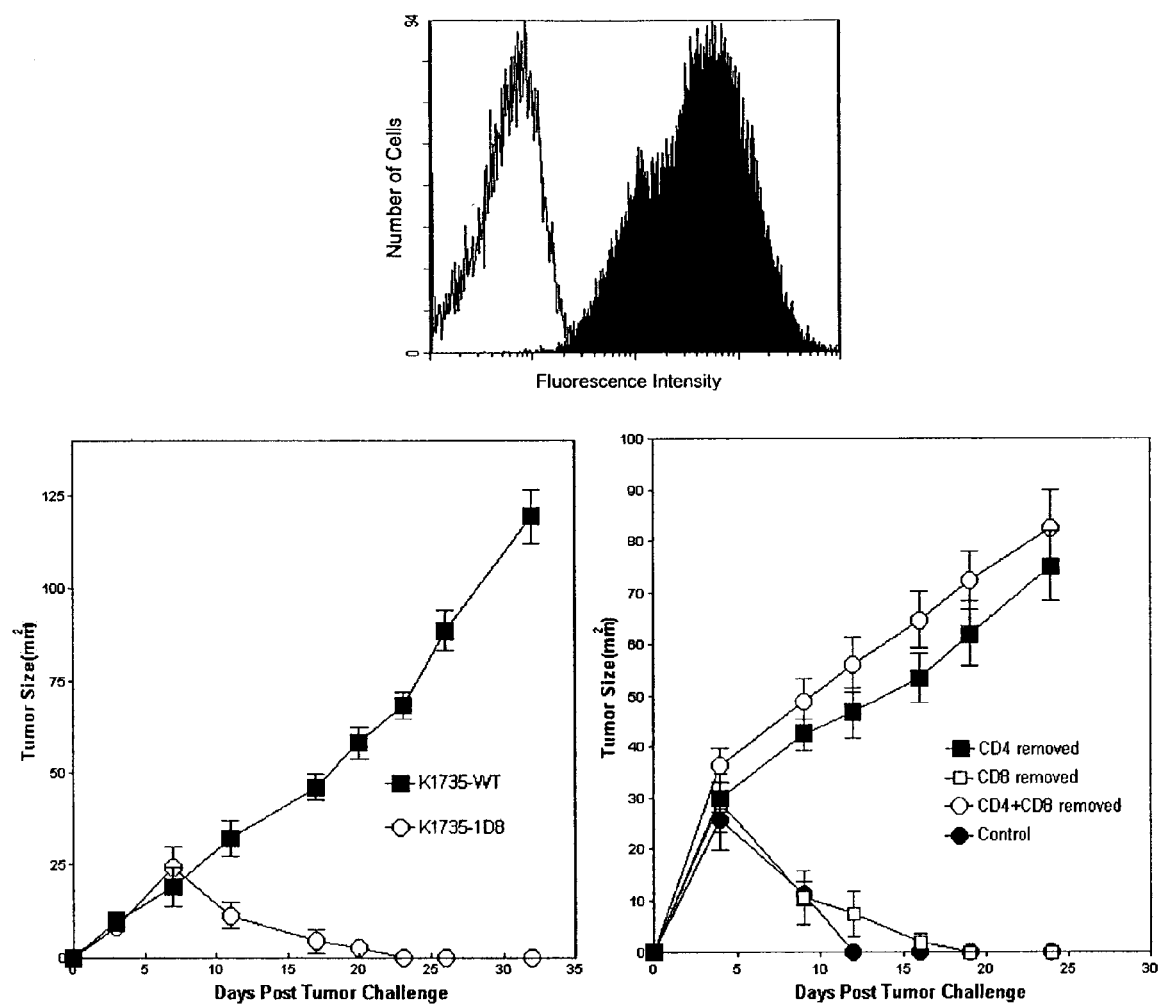
FIG. 41A illustrates cell surface expression of 1D8 (anti-murine 4-1BB) scFv IgG WTH WTCH2CH3-CD80 fusion protein on K1735 melanoma cells by flow immunofluorimetry. The scFv fusion protein was detected with phycoerythrin-conjugated F(ab')₂ goat anti-human IgG.
FIG. 41B depicts growth of tumors in naïve C3H mice transplanted by subcutaneous injection with wild type K1735 melanoma cells (K1735-WT) or with K1735 cells transfected with 1D8 scFv IgG WTH WTCH2CH3-CD80 (K1735-1D8). Tumor growth was monitored by measuring the size of the tumor.
FIG. 41C demonstrates the kinetics of tumor growth in naïve C3H mice injected intraperitoneally with monoclonal antibodies to remove $CD8^+$, $CD4^+$, or both $CD4^+$ and $CD8^+$ T cells prior to transplantation of the animals with K1735-1D8 cells.

The growth of K1735-1D8 transfected cells was examined in vivo. K1735-WT cells grew progressively when transplanted subcutaneously (s.c.) in naïve C3H mice. Although the same dose of K1735-1D8 cells initially formed tumors of an approximately 30 mm$^2$ surface area, the tumors started to regress around day 7 and had disappeared by day 20 as shown in FIG. 41B. Tumor cells that were transfected with a similarly constructed vector encoding a non-binding scFv, a human anti-CD28 scFv construct, grew as well as tumor cells that had not been transfected. The presence of a foreign protein, that is, human IgG1 constant domains or rat variable regions, did not make transfected K1735-WT cells immunogenic; the growth of the K1735-1D8 cells in C3H mice was identical to that of K1735-WT cells (untransfected).

To investigate the roles of CD4$^+$ and CD8$^+$ T lymphocytes and NK cells in the regression of K1735-1D8 tumors, naïve mice were injected intraperitoneally (i.p.) with monoclonal antibodies (mAbs, typically 50 µg in a volume 0.1 ml) to remove CD8$^+$, CD4$^+$ or both CD4$^+$ and CD8$^+$ T cells, or were injected with anti-asialo-GM1 rabbit antibodies to remove NK cells. Twelve days later, when flow cytometry analysis of spleen cells from identically treated mice showed that the targeted T cell populations were depleted, K1735-1D8 cells were transplanted s.c to each T cell-depleted group. K1735-1D8 had similar growth kinetics in mice that had been injected with the anti-CD8 MAb or control rat IgG while removal of CD4$^+$ T cells resulted in the growth of K1735-1D8 with the same kinetics as K1735-WT. This failure to inhibit tumor growth after CD4+ T cell removal was observed regardless of the presence or absence of CD8+ T cells. K1735-1D8 grew in all NK-depleted mice, although more slowly than in the CD4-depleted group. The results are presented in FIG. 41C.

Example 26

Therapeutic Effect of Tumor Cells Expressing Anti-4-1BB scFv IgG-CD80 Fusion Protein This Example examines the ability of K1735-1D8 transfected tumor cells expressing an anti-CD137 scFv on the cell surface to generate a sufficient immune response in mice to mediate rejection of established, untransfected wild type tumors. C3H mice were transplanted with K1735-WT tumors (2×10$^6$ cells/animal) and grown for approximately six days. Experiments were performed using mice with established K1735-WT tumors of 30 mm$^2$ surface area. Mice were vaccinated by s.c. injection of K1735-1D8 or irradiated K1735-

Figure 42:
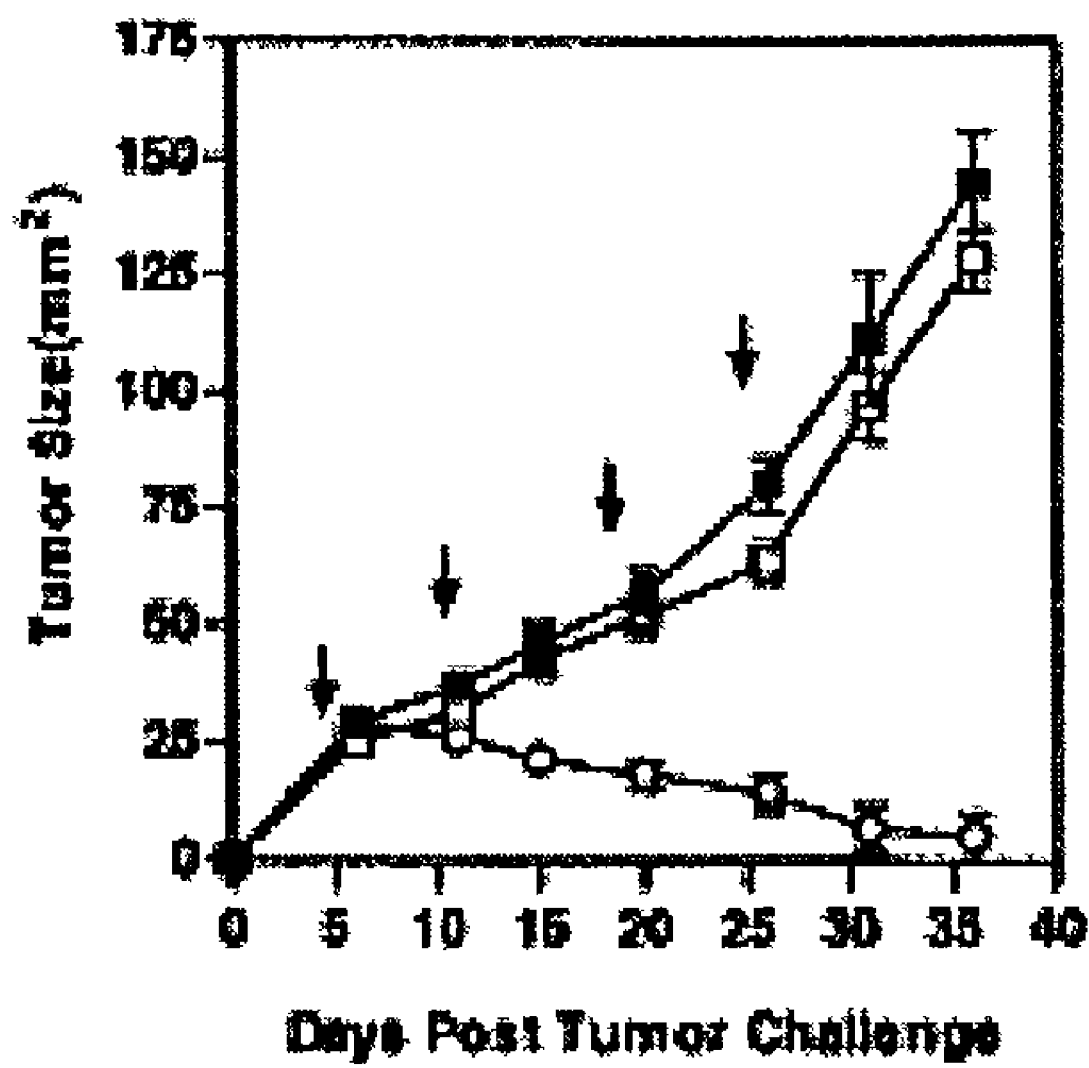
FIG. 42 demonstrates therapy of established K1735-WT tumors using K1735-1D8 as an immunogen. Six days after mice were transplanted with K1735-WT tumors, one group (five animals) was injected subcutaneously with K1735-1D8 cells (open circles) or irradiated K1735-WT cells (solid squares) on the contralateral side. A control group of mice received PBS (open squares). Treatments were repeated on the days indicated by the arrows.
Figure 43:
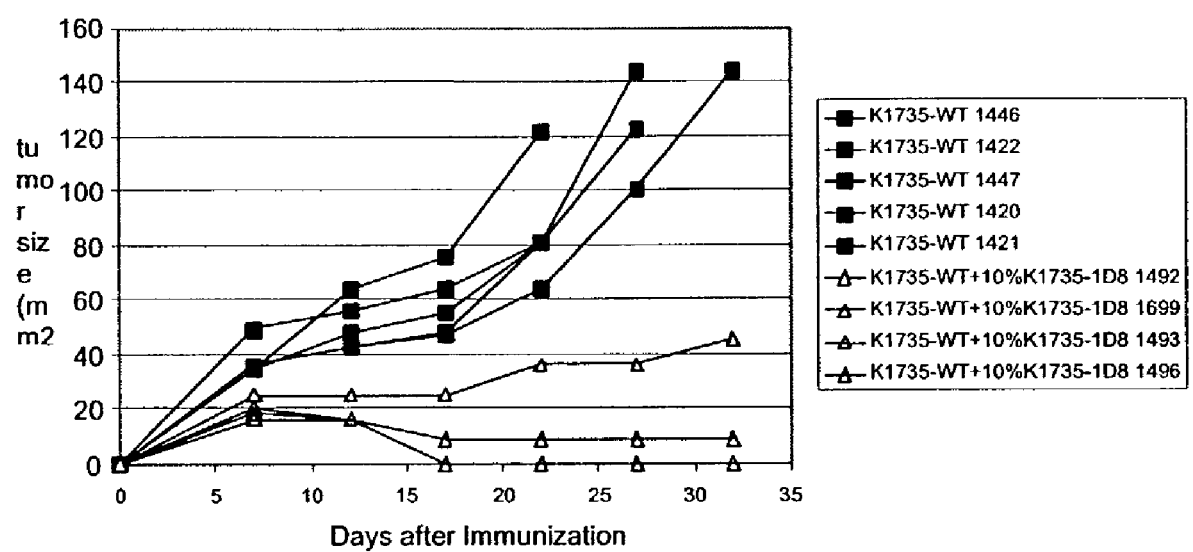
FIG. 43 shows the growth of tumors in animals that were injected subcutaneously with $2\times10^6$ K1735-WT cells (solid squares) and the growth of tumors in animals that were injected subcutaneously with $2\times10^6$ K1735-WT cells plus $2\times10^5$ K1735-1D8 cells (open triangles).

WT cells on the contralateral side. Identical injections were repeated at the time points indicated in FIG. 42. One group of animals was given four weekly injections of K1735-1D8 cells. According to the same schedule, another group was given irradiated (12,000 rads) K1735-WT cells, and a third group was injected with PBS. The data are plotted in FIG. 42. The WT tumors grew progressively in all control mice and in all mice that received irradiated K1735-WT cells. In contrast, the tumors regressed in 4 of the 5 mice treated by immunization with K1735-1D8. The animals remained tumor-free and without signs of toxicity when the experiment was terminated 3 months later. In the fifth mouse, the tumor nodule decreased in size as long as the mouse received K1735-1D8 cells, but the tumor grew back after therapy was terminated.

In another experiment with 5 mice/group, mice were injected intravenously (i.v.) with $3 \times 10^5$ K1735-WT cells to initiate lung metastases. Three days later, K1735-1D8 cells were transplanted s.c. This procedure was repeated once weekly for a month; control mice were injected with PBS. The experiment was terminated when one mouse in the control group died, 37 days after receiving the K1735-WT cells. At that time, lungs of the control mice each had >500 metastatic foci. In contrast, less than 10 metastatic foci were present in the lungs of the immunized mice.

In a third experiment, mixtures of K1735-WT cells and K1735-1D8 cells were injected into immunocompetent syngeneic C3H mice. Mice were injected subcutaneously with K7135-WT cells alone or with a mixture of $2 \times 10^6$ K1735-WT cells and $2 \times 10^5$ K1735-1D8 cells. Tumor growth was monitored at 5-day intervals.

Example 27

Expression of Anti-4-1BB scFv IgG-CD80 Fusion Protein on the Cell Surface of Sarcoma Cells This Example demonstrates expression of an anti-CD137 scFv on the cell surface of a second type of tumor cell by transfecting a murine sarcoma cell line with an anti-CD137 scFv IgG-CD80 construct.

Figure 44:
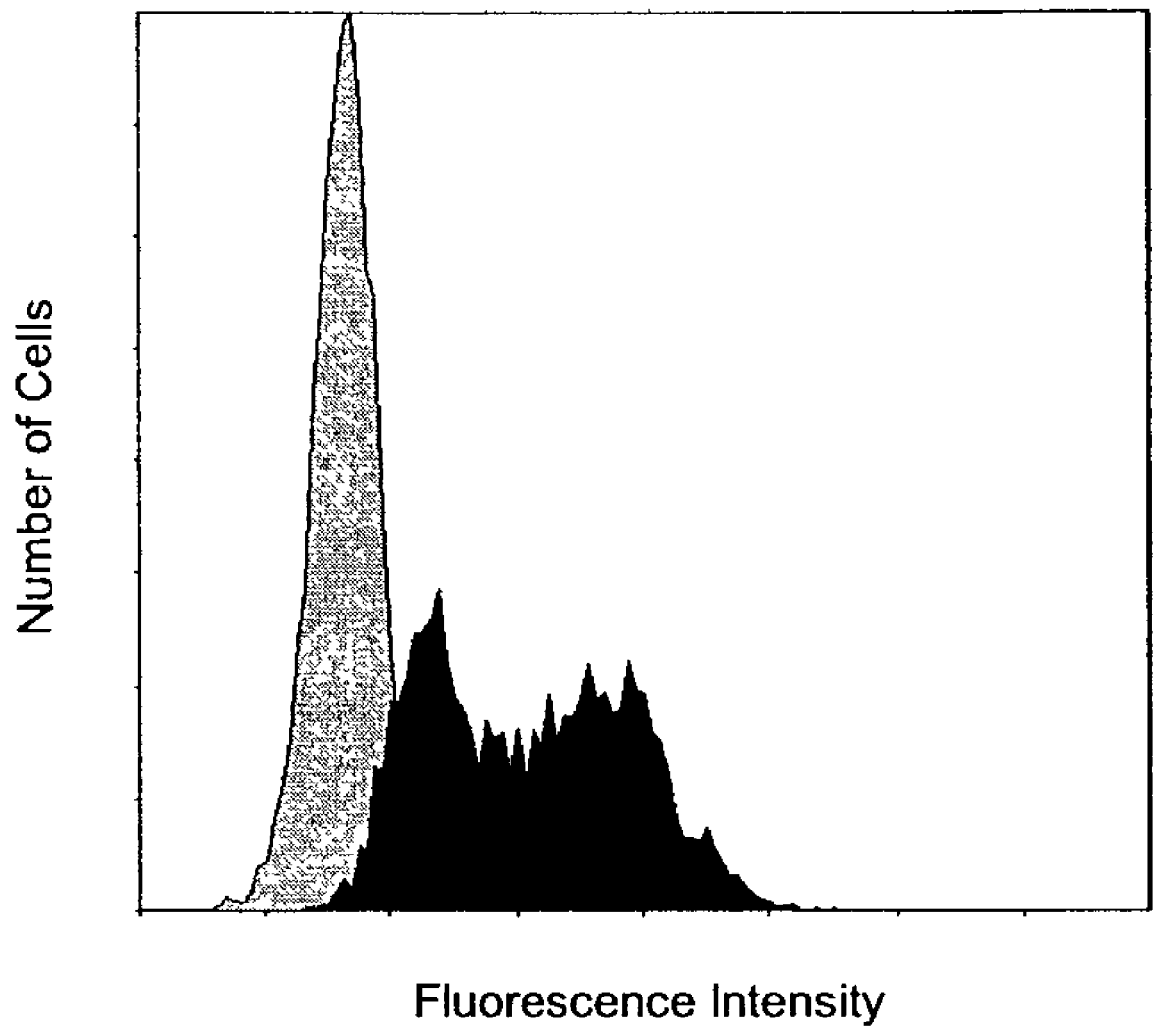
FIG. 44 presents a flow cytometry analysis of Ag104 murine sarcoma tumor cells transfected with 1D8 scFv IgG WTH WTCH2CH3-CD80 isolated after repeated rounds of panning against anti-human IgG. Transfected cells expressing 1D8 scFv IgG WTH WTCH2CH3-CD80 were detected with fluoroisothiocyanate (FITC)-conjugated goat anti-human IgG (depicted in black). Untransfected cells are shown in gray.

The 1D8 scFv IgG WTH WTCH2CH3-CD80 polynucleotide (SEQ ID NO: 340) was transferred from the pLNCX vector into pcDNA3-hygro vector using restriction enzyme digestion and ligation steps according to standard molecular biology methods. The construct was cut with HindIII+Cla1 and the sFv fragment was filled in with Klenow (Roche) and the blunt-ended fragment was ligated into EcoR5 site of pcDNA3. Ag104 murine sarcoma tumor cells were transfected with the pcDNA3-hygro vector containing the 1D8 scFv IgG CD80 fusion protein. Hygromycin-resistant clones were screened by flow cytometry using a FITC anti-human IgG antibody to detect expression of the transgene. Only approximately 15% of the resistant clones had detectable fusion protein initially. Positive cells identified by flow cytometry were repeatedly panned on flasks coated with immobilized anti-human IgG (10 µg/ml) according to standard methods. Panning was performed by incubating cells on the coated plates for 30 min at 37 C; the plates were then washed 2-3× in versene or PBS. After each round, cells were tested for IgG expression by FACS. The histogram in FIG. 44 shows the staining pattern after four rounds of panning against anti-human IgG (black). Untransfected cells were stained and are indicated in gray. All of the cells in the population were positive.

Example 28

Construction and Characterization of a Bispecific scFv Ig Fusion Protein and scFv Ig Fusion Proteins with a Mutation in the IgG1 CH2 Domain An anti-CD20 (2H7) scFv IgG fusion protein was constructed that had a mutant hinge (MT (SSS)) and a mutant CH2 domain in which the proline at residue (position number 238 according to Ward et al., supra) was substituted with a serine. The 2H7 scFv IgG MTH (SSS) MTCH2WTCH3 encoding polynucleotide (SEQ ID NO: 3, 351) was constructed essentially according to methods described in Examples 1, 5, and 13. The IgG mutant hinge-mutant CH2-wild type CH3 domains were also fused to an anti-CD20 (2H7)-anti-CD40 (40.2.220) bispecific scFv. The anti-CD20-anti-CD40 scFv IgG MTH (SSS) MTCH2WTCH3 encoding polynucleotide sequence is shown in SEQ ID NO: 349 and the encoded polypeptide is shown in SEQ ID NO: 350.

Figure 45:
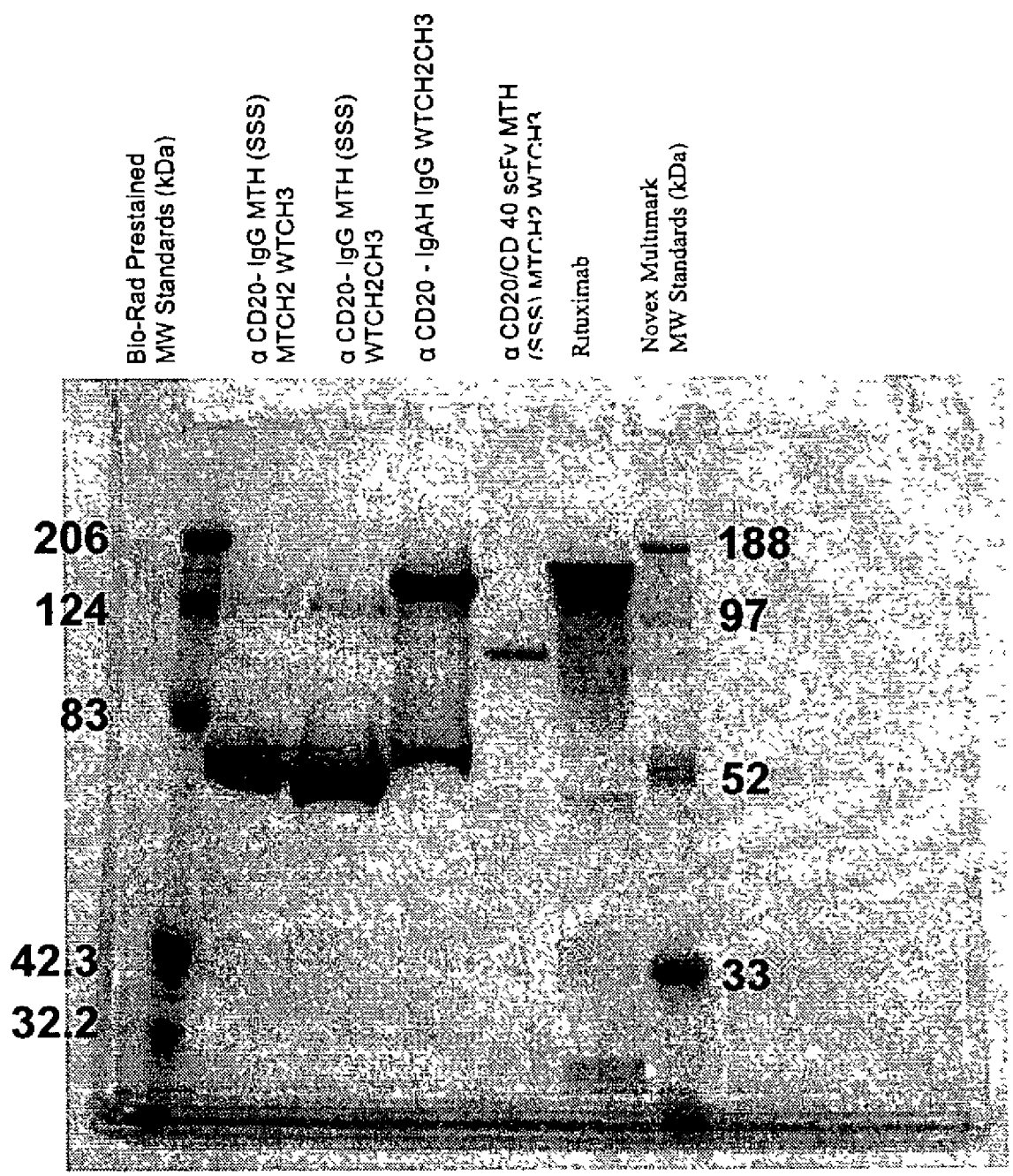
FIG. 45 illustrates migration of various 2H7 scFv Ig fusion proteins in a 10% SDS-PAGE gel. 2H7 was the anti-CD20 scFv and 4.2.220 was the anti-CD40 scFv. Lane 1: Bio-Rad prestained molecular weight standards; lane 2: anti-CD20 scFv IgG MTH (SSS) MTCH2WTCH3; lane 3: anti-CD20 scFv IgG MTH (SSS) WTCH2CH3; lane 4: 2H7 scFv IgAH IgG WTCH2CH3; lane 5: anti-CD20-anti-CD40 scFv IgG MTH (SSS) MTCH2WTCH3; lane 6: Rituximab; lane 7: Novex MULTIMARK molecular weight standards.

COS cells were transiently transfected with vectors comprising the polynucleotide sequences encoding 2H7 scFv IgG MTH (SSS) MTCH2WTCH3 (SEQ ID NO: 3, 351); anti-CD20-anti-CD40 scFv IgG MTH (SSS) MTCH2WTCH3 (SEQ ID NO: 349); 2H7 scFv IgG MTH (SSS) WTCH2CH3 (SEQ ID NO: 4, 225); and 2H7 scFv IgAH IgG WTCH2CH3 (SEQ ID NO: 5, 283) as described in Example 10. Culture supernatants were collected and the fusion proteins were purified by protein A chromatography (see Example 10). The purified polypeptides were fractionated by SDS-PAGE according to the method described in Example 10. Rituximab (anti-CD20 monoclonal antibody), and Bio-Rad prestained molecular weight standards (Bio-Rad, Hercules, Calif.), and MULTIMARK® molecular weight standards (Invitrogen Life Technologies were also applied to the gel. The results are presented in FIG. 45.

Figure 46:
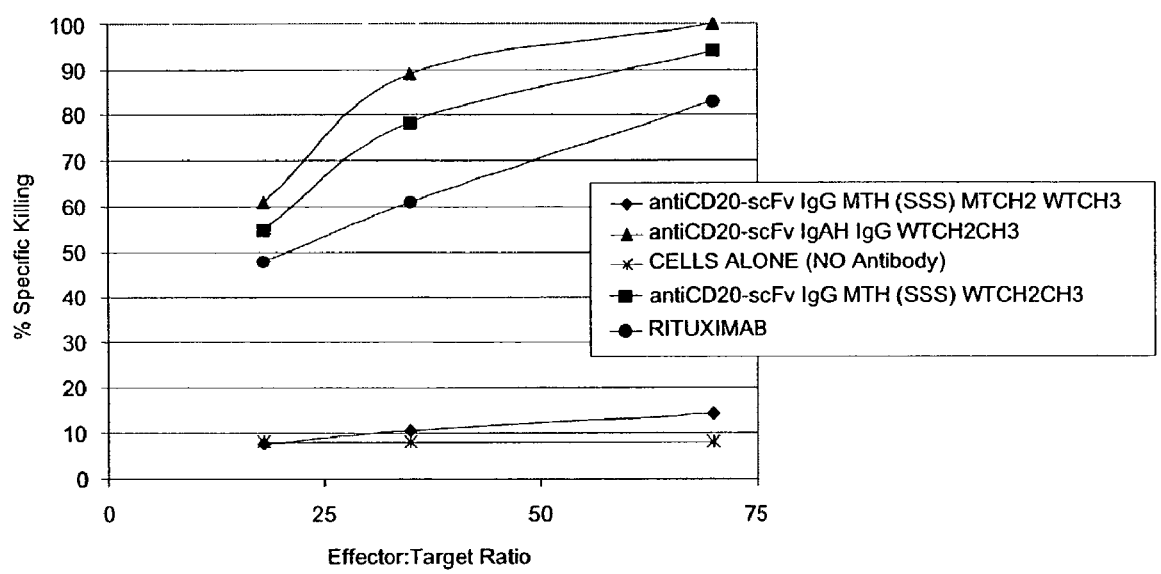
FIG. 46 illustrates effector function as measured in an ADCC assay of 2H7 Ig fusion proteins that contain a mutant CH2 domain or wild type CH2 domain. The percent specific killing of BJAB target cells in the presence of human PBMC effector cells by 2H7 scFv IgG MTH (SSS) MTCH2WTCH3 (diamonds) was compared to 2H7 scFv IgG MTH (SSS) WTCH2CH3 (squares) and 2H7 scFv IgAH IgG WTCH2CH3 (triangles) and Rituximab (circles).

The 2H7 scFv Ig fusion protein that contains a mutation in the CH2 domain was compared to fusion proteins that have the wild type CH2 domain in an ADCC assay. The assays were performed essentially as described in Examples 11 and 19. Fresh resting PBMC (effector cells) were added to $^{51}$Cr-labeled BJAB cells (target cells) at the ratios indicated in FIG. 46. Purified 2H7 scFv IgG MTH (SSS) MTCH2WTCH3, 2H7 scFv IgG MTH (SSS) WTCH2CH3, 2H7 scFv IgAH IgG WTCH2CH3, and Rituximab, each at 10 µg/ml were added to the effector/target cell mixtures and incubated for five hours at 37° C. Supernatants were harvested and the amount of chromium released was determined as described in Examples 11 and 19. Percent specific killing by each fusion protein is presented in FIG. 46.

Example 29

Tumor Cell Surface Expression of an Anti-Human CD3 scFv IgG Fusion Protein

Figure 47:
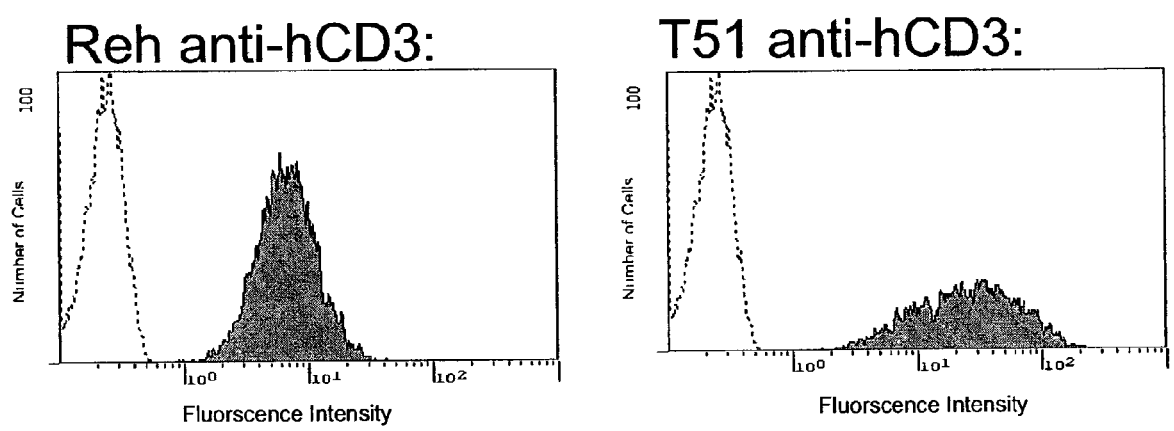
FIG. 47 shows cell surface expression of an anti-human CD3 scFv IgG WTH WTCH2CH3-CD80 (SEQ ID NO: 560) fusion protein on Reh cells (FIG. 47A) and T51 lymphoblastoid cells (FIG. 47B) by flow immunocytofluorimetry.

An anti-human CD3 scFv Ig CD80 fusion protein was prepared essentially as described in Examples 1 and 12. The fusion protein comprised an anti-human CD3 scFv fused to wild type IgG1 hinge (SEQ ID NO: 436, 438) and wild type CH2 (SEQ ID NO: 440) and CH3 (SEQ ID NO: 442) domains, fused to CD80 transmembrane and cytoplasmic domains (SEQ ID NO: 461) to enable cell surface expression of the anti-CD3 scFv. The anti-human CD3 scFv IgG WTH WTCH2CH3-CD80 polynucleotide (SEQ ID NO: 559) encoding the polypeptide (SEQ ID NO: 560) was transfected in Reh cells and into T51 cells (lymphoblastoid cell line). Expression of the anti-human CD3 scFv IgG fusion protein was detected by flow cytometry using FITC conjugated goat anti-human IgG (see methods in Examples 4, 10, 16, 18). FIG. 47A illustrates expression of the anti-human CD3 fusion protein on the cell surface of Reh cells, and FIG. 47B shows expression of the fusion protein on T41 cells.

Figures 48A, 48B:
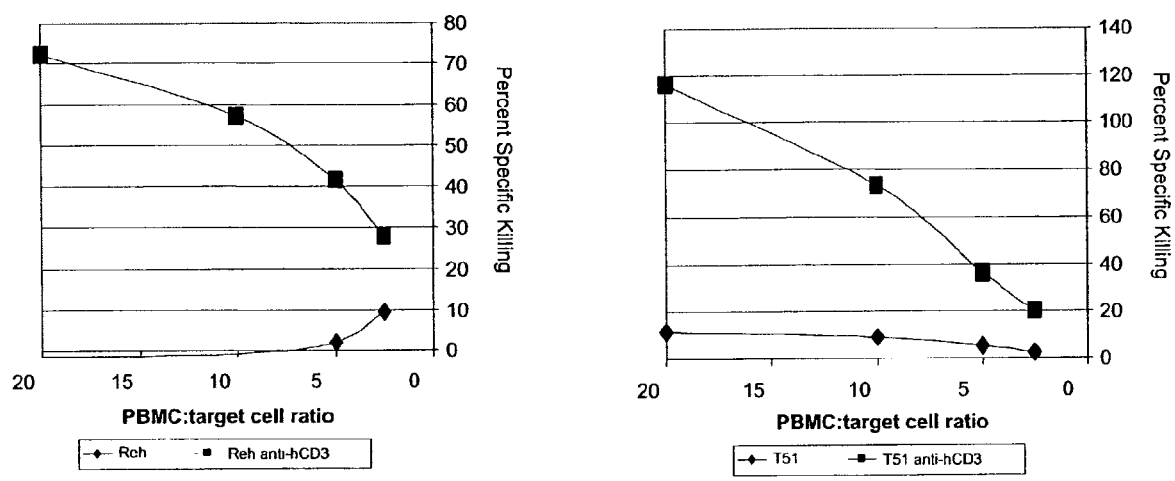
FIG. 48 presents the percent specific killing of untransfected Reh and T51 cells and the percent specific killing of Reh cells (Reh anti-hCD3) (FIG. 48A) and T51 cells (T51 anti-hCD3) (FIG. 48B) that were transfected with a construct encoding scFv antibodies specific for human CD3, fused to human IgG1 wild-type hinge-CH2-CH3, which was fused to human CD80 transmembrane and cytoplasmic tail domains (anti-human CD3 scFv IgG WTH WTCH2CH3-CD80 (SEQ ID NO: 560). Human PBMC (effector cells) were combined with BJAB target cells at the ratios indicated.

ADCC assays were performed with the transfected Reh and T51 cells to determine if expression of the scFv-Ig polypeptides on the cell surface augmented effector cell function. Untransfected and transfected Reh cells and untransfected and transfected T51 cells were pre-labeled with $^{51}$Cr (100 µCi) (Amersham) for two hours at 37° C. Human PBMC served as effector cells and were added to the target cells ($5 \times 10^4$ cells per well of 96 well plate) at ratios of 20:1, 10:1, 5:1, and 2.5:1. After four hours at 37° C., culture supernatants were harvested and analyzed as described in Examples 11 and 12. Percent specific killing was calculated as described in Example 12. The results are presented in FIG. 48.

Example 30

Induction of Cytokine Expression in Tumor Cells Expressing Anti-CD28 scFv on the Cell Surface This Example describes the effect of cell surface expressed scFv on cytokine mRNA induction in stimulated lymphocytes co-cultured with tumor cells transfected with an anti-human CD28 scFv IgG-CD80 fusion protein.

Real time PCR analysis was performed on RNA samples from human PBMC stimulated with Reh, Reh-anti-CD28 (2e12) (see Example 12 for construction of 2e12 scFv IgG WTH WHTCH3CH2-CD80 and transfection of Reh cells), and Reh-CD80 (see Example 14) in order to measure the effects of the surface expressed scFv on cytokine production by the PBMC effector cells. For the real-time PCR assay, SYBR. Green (QIAGEN) (Morrison et al., *Biotechniques* 24:954-8, 960, 962 (1998)) was used and measured by an ABI PRISM® 7000 Sequence Detection System (Applied Biosystems, Foster City, Calif.) that measures the formation of PCR product after each amplification cycle. Cells were harvested from cultures and total RNA prepared using QIAGEN RNA kits, including a QIA shredder column purification system to homogenize cell lysates, and RNEASY® mini-columns for purification of RNA. cDNA was reverse transcribed using equal amounts of RNA from each cell type and Superscript II Reverse Transcriptase (Life Technologies). Sybr Green real-time PCR analysis was then performed using the prepared cDNA as template and primer pairs specific for cytokine gene products. The average length of the PCR products that were amplified ranged from 150-250 base pairs. The cDNA levels for many activation response molecules including IFNγ, TNFα, GM-CSF, IL-4, IL-5, IL-6, IL-8, IL-10, IL-12, IL-15, ICOSL, CD80 and CD86 were assayed. Control reference cDNAs for constitutively expressed genes, including GAPDH, β-actin, and CD3ε were measured in each assay. The most significant induction of specific mRNA was observed for IFN-γ, and more modest induction was observed for CTLA-4 and ICOS.

Example 31

Cloning of an Anti-Human 4-1BB Antibody and Construction of an Anti-Human 4-1BB scFv Ig Fusion Protein A hybridoma cell line expressing a mouse anti-human monoclonal antibody (designated 5B9) was obtained from Dr. Robert Mittler, Emory University Vaccine Center, Atlanta, Ga. The variable heavy and light chain regions were cloned according to known methods for cloning of immunoglobulin genes and as described herein. Cells were grown in IMDM/15% FBS (Invitrogen Life Technologies) media for several days. Cells in logarithmic growth were harvested from cultures and total RNA prepared using QIAGEN RNA kits, including a QIA shredder column purification system to homogenize cell lysates, and RNeasy RNEASY® mini-columns for purification of RNA according to manufacturer's instructions. cDNA was reverse transcribed using random hexamer primers and Superscript II Reverse Transcriptase (Invitrogen Life Technologies).

cDNA was anchor-tailed using terminal transferase and dGTP. PCR was then performed using an anchor-tail complementary primer and a primer that annealed specifically to the antisense strand of the constant region of either mouse Ck (for amplification of VL) or the appropriate isotype mouse CH1 (for amplification of VH). The amplified variable region fragments were TOPO® cloned (Invitrogen Life Technologies), and clones with inserts of the correct size were then sequenced. Consensus sequence for each variable domain was determined from sequence of at least four independent clones. The 5B9 VL and VH polynucleotide sequences are shown in SEQ ID NOs: 355 and 354, respectively, and the deduced amino acid sequences are shown in SEQ ID NOs: 361 and 360. The scFv was constructed by a sewing PCR method using overlapping primers containing a synthetic $(gly_4ser)_3$ linker domain inserted between the light and heavy chain variable regions (see Example 1). The 5B9 scFv polypeptide (SEQ ID NO: 356) is encoded by the polynucleotide sequence comprising SEQ ID NO: 362.

Figure 49:
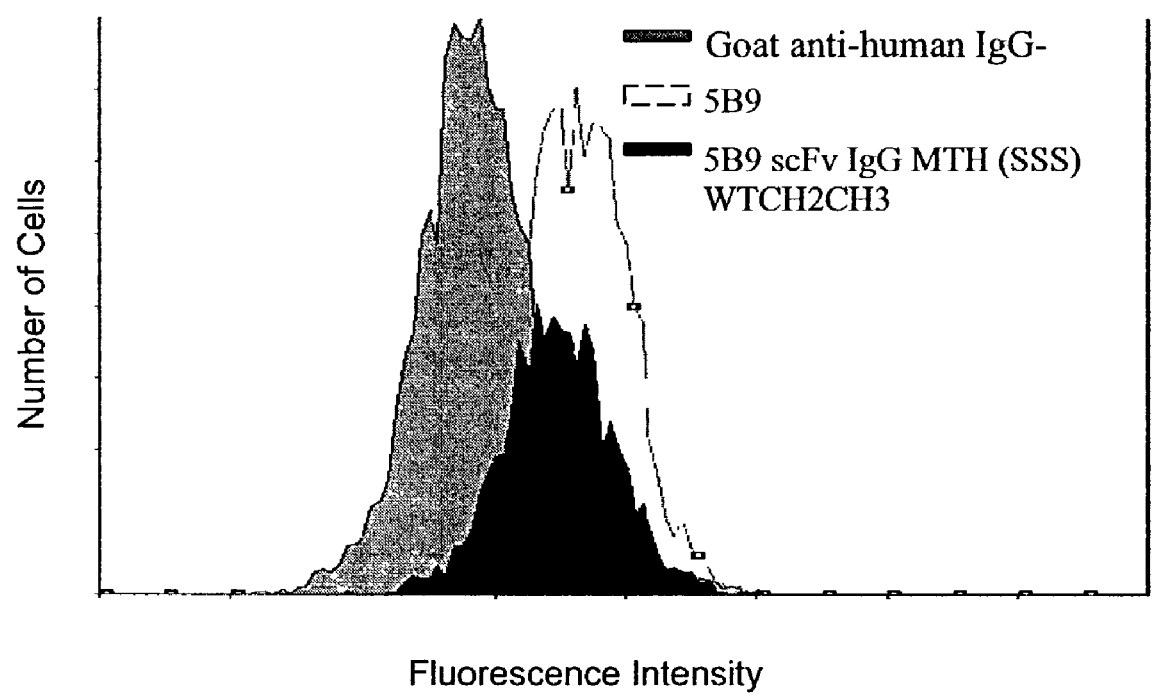
FIG. 49 illustrates binding of 5B9, a murine anti-human CD137 (4-1BB) monoclonal antibody, and a 5B9 scFv IgG fusion protein (5B9 scFv IgG MTH (SSS) WTCH2CH3 (SEQ ID NO: 363)) to stimulated human PBMC. Binding of the 5B9 scFv IgG fusion protein was detected by flow immunocytofluorimetry using FITC conjugated goat anti-human IgG. Binding of the 5B9 monoclonal antibody was detected with FITC conjugated goat anti-mouse IgG.

5B9 scFv polynucleotide sequence was fused in frame to the polynucleotide sequence encoding the human IgG1 mutant hinge and wild type CH2 and CH3 (MTH (SSS) WTCH2CH3, SEQ ID NO: 357) according to methods described in Examples 5, 10, and 13. COS cells were transiently transfected with a vector comprising the 5B9 scFv IgG MTH (SSS) WTCH2CH3 polynucleotide sequence (SEQ ID NO: 357). Supernatant was collected and binding of the 5B9 scFv IgG MTH (SSS) WTCH2CH3 polypeptide (SEQ ID NO: 362) was measured by flow immunocytofluorimetry essentially as described in Examples 4, 10, 16, and 18. Culture supernatant from the 5B9 hybridoma cell line was also included in the binding assay. Fresh human PBMC were incubated in the presence of immobilized anti-CD3 for four days prior to the binding experiment to induce expression of CD137 on the surface of activated T cells. Stimulated PBMC were washed and incubated with COS or hybridoma culture supernatant containing the 5B9 scFv IgG fusion protein or 5B9 murine monoclonal antibody, respectively, for 1 hour on ice. Binding of 5B9 scFv IgG fusion protein or 5B9 murine monoclonal antibody was detected with FITC conjugated anti-human IgG or anti-mouse IgG, respectively. The results are presented in FIG. 49.

Example 32

Construction of 2H7 scFv IgG Fusion Proteins with Hinge Mutations

A 2H7 scFv IgG fusion proteins are constructed with the first cysteine residue and the second cysteine in the IgG1 hinge region substituted with a serine residue to provide MTH (SCC) and MTH (CSC). The template for introduction of the mutations is a polynucleotide encoding 2H7 scFv WTH WTCH2CH3 (SEQ ID NO: 2, 207). The oligonucleotide introducing the mutations are 5' PCR primer oligonucleotides HIgGMHcys1 (SEQ ID NO: 587) and HIgGMHcys2 (SEQ ID NO: 391). The encoding polynucleotides of the mutants are presented in SEQ ID NOs: 393, 394 and the polypeptide sequences are provided in SEQ ID NO: 396, 397.

Additional representative sequences of the present invention are as follows:

```
HuIgG1 wild type hinge, CH2, CH3 (SEQ ID NO: 427)
tctgatcaggagcccaaatcttgtgacaaaactcacacatgcccaccgtgcccagcacctgaactcctgggggaccgtcagtctt cctcttcccccaaaacccaaggacaccctcatgatctcccggacccctgaggtcacatgcgtggtggtggacgtgagccacgaa gaccctgaggtcaagttcaactggtacgtggacggcgtggaggtgcataatgccaagacaaagccgcgggaggagcagtacaa cagcacgtaccgtgtggtcagcgtcctcaccgtcctgcaccaggactggctgaatggcaaggagtacaagtgcaaggtctccaac aaagcccctcccagccccatcgagaaaacaatctccaaagccaaagggcagccccgagaaccacaggtgtacaccctgccccc atcccgggatgagctgaccaagaaccaggtcagcctgacctgcctggtcaaaggcttctatcccagcgacatcgccgtggagtgg gagagcaatgggcagccggagaacaactacaagaccacgcctcccgtgctggactccgacggctccttcttcctctacagcaag ctcaccgtggacaagagcaggtggcagcaggggaacgtcttctcatgctccgtgatgcatgaggctctgcacaaccactacacgc agaagagcctctccctgtctccgggtaaatgatctaga HuIgG1 wild type hinge, CH2, CH3 (SEQ ID NO: 428)
sdqepkscdkthtcppcpapellggpsvflfppkpkdtlmisrtpevtcvvvdvshedpevkfnwyvd gvevhnaktkpreeqynstyrvvsvltvlhqdwlngkeykckvsnkalpapiektiskakgqprepqvytlppsrdeltknqv sltclvkgfypsdiavewesngqpennykttppvldsdgsfflyskltvdksrwqqgnvfscsvmhealhnhytqkslslspg k Llama IgG1 hinge, CH2, CH3 (SEQ ID NO: 429)
tgatcaagaaccacatggaggatgcacgtgcccncagtgcccncaatgcccngcnccngaactnccagg aggcccttctgtctttgtcttcccccgaaacccaaggacgtcctctccattttggaggccgagtcacgtgcgttgtagtggacgtcg gaaagaaagaccccgaggtcaatttcaactggtatattgatggcgttgaggtgcgaacggccaatacgaagccaaaagaggaac agttcaacagcacgtaccgcgtggtcagcgtcctgcccatccagcaccaggactggctgacggggaaggaattcaagtgcaagg tcaacaacaaagctctcccggcccccatcgagaggaccatctccaaggccaaagggcagacccgggagccgcaggtgtacacc ctggcccacaccgggaagaactggccaaggacaccgtgagcgtaacatgcctggtcaaaggcttctacccagctgacatcaac gttgagtggcagaggaacggtcagccggagtcagagggcacctacgccaacacgccgccacagctggacaacgacgggacct acttcctctacagcaagctctcggtggaaagaacacgtggcagcggggagaaaccttaacctgtgtggtgatgcatgaggccct gcacaaccactacacccagaaatccatcacccagtcttcgggtaaatagtaatctaga Llama IgG1 hinge, CH2, CH3 (In FIG. 23 as Llama IgG1) (SEQ ID NO: 430)
ephggctcpqcpapelpggpsvfvfppkpkdvlsisgrpevtcvvvdvgkedpevnfnwyidgvevr tantkpkeeqfnstyrvvsvlpiqhqdwltgketkckvnnkalpapiertiskakgqtrepqvytlaphreelakdtvsvtclvk gfypadinvewqmgqpesegtyantppqldndgtyflysrlsvgkntwqrgctltgvvmhealhnhytqksitqssgk Llama IgG2: (SEQ ID NO: 431)
tgatcaagaacccaagacaccaaaaccacaaccacaaccacaaccacaacccaatcctacaacagaatccaagtgtcccaaatgt ccagcccctgagctcctgggagggccctcagtcttcatcttcccccgaaacccaaggacgtcctctccatttctgggaggcccga ggtcacgtgcgttgtggtagacgtgggccaggaagaccccgaggtcagtttcaactggtacattgatggcgctgaggtgcgaacg gccaacacgaggccaaaagaggaacagttcaacagcacgtaccgcgtggtcagcgtcctgcccatccagcaccaggactggct gacggggaaggaattcaagtgcaaggtcaacaacaaagctctcccggcccccatcgagaagaccatctccaaggccaaagggc agacccgggagccgcaggtgtacaccctggccccacaccgggaagagctggccaaggacaccgtgagcgtaacatgcctggt caaaggcttctacccacctgatatcaacgttgagtggcagaggaatgggcagccggagtcagagggcacytacgccaccacgcc
``` accccagctggacaacgacgggacctacttcctctacagcaagctctcggtgggaaagaacacgtggcagcagggagaaacctt cacctgtgtggtgatgcacgaggccctgcacaaccactacacccagaaatccatcacccagtcttcgggtaaatagtaatctaga Llama IgG2 (SEQ ID NO: 432)
Dqepktpkpqpqpqpqpnptteskcpkcpapellggpsvfifppkpkdvlsisgrpevtcvvvdvgq edpevsfnwyidgaevrtantrpkeeqfnstyrvvsvlpiqhqdwltgkefkckvnnkalpapiektiskakgqtrepqvytla phreelakdtvsvtclvkgfyppdinvewqmgqpesegtyattppqldndgtyflysklsvgkntwqqgctftcvvmhealh nhytqksitqssgk Llama IgG3 Fc (SEQ ID NO: 433)
tgatcaagcgcaccacagcgaagaccccagctccaagtgtcccaaatgcccaggccctgaactccttgga gggcccacggtcttcatcttccccccgaaagccaaggacgtcctctccatcacccgaaaacctgaggtcacgtgcttgtggtggac gtgggtaaagaagaccctgagatcgagttcaagctggtccgtggatgacacagaggtacacacggctgagacaaagccaaagg aggaacagttcaacagcacgtaccgcgtggtcagcgtcctgcccatccagcaccaggactggctgacggggaaggaattcaagt gcaaggtcaacaacaaagctctcccagcccccatcgagaggaccatctccaaggccaaagggcagacccgggagccgcaggt gtacaccctggccccacaccgggaagagctggccaaggacaccgtgagcgtaacctgcctggtcaaaggcttcttcccagctga catcaacgttgagtggcagaggaatgggcagccggagtcagaggggcacctacgccaacacgccgccacagctggacaacgac gggacctacttcctctacagcaaactctccgtgggaaagaacacgtggcagcagggagaagtcttcacctgtgtggtgatgcacg aggctctacacaatcactccacccagaaatccatcacccagtcttcgggtaaatagtaatctagagggccc Llama IgG3 Fc (SEQ ID NO: 434)
dqahhsedpsskepkcpgpellggptvfifppkakdvlsitrkpevtclwwtwvkktlrssssswsvddt evhtaetkpkeeqfnstyrvvsvlpiqhqdwltgkefkekvnnkalpapiertiskakgqtrepqvytlaphreelakdtvsvte lvkgffpadinvewqrngqpesegtyantppqldndgtyflysklsvgkntwqqgevftcvvmhealhnhstqksitqssgk HuIgG1 wild type hinge (SEQ ID NO: 435)
gatcaggagcccaaatcttgtgacaaaactcacacatgcccaccgtgcccagca HuIgG1 wild type hinge (SEQ ID NO: 436)
dqepkscdkthtcppcpa HuIgG1 H2, wild type hinge with leu at second position (results from BglI site)
(SEQ ID NO: 437)
gatctggagcccaaatcttgtgacaaaactcacccatgcccaccgtgcccagca HuIgG1 H2, wild type hinge with leu at second position.
(SEQ ID NO: 438)
dlepkscdkthtcppcpa NT
HuIgG1 wild type CH2 (SEQ ID NO: 439)
cctgaactcctggggggaccgtcagtcttcctcttccccccaaaacccaaggacaccctcatgatctcccgg acccctgaggtcacatgcgtggtggtggacgtgagccacgaagaccctgaggtcaagttcaactggtacgtggacggcgtggag gtgcataatgccaagacaaagccgcgggaggagcagtacaacagcacgtaccgtgtggtcagcgtcctcaccgtcctgcaccag gactggctgaatggcaaggagtacaagtgcaaggtctccaacaaagcccttcccagcccccatcgagaaaaccatctccaaagcc aaa HuIgG1 wild type CH2 AA (SEQ ID NO: 440)
pellggpsvflfppkpkdtlmisrtpevtcvvvdvshedpevkfnwyvdgvevhnaktkpreeqynst yrvvsvltvlhqdwlngkeykckvsnkalpapiektiskak NT HuIgG1 wild type CH3 (SEQ ID NO: 441)
gggcagccccgagaaccacaggtgtacaccctgcccccatcccgggaggagatgaccaagaaccaggt cagcctgacctgcctggtcaaaggcttctatcccagcgacatcgccgtggagtgggagagcaatgggcagccggagaacaacta caagaccacgcctcccgtgctggactccgaeggctccttcttcctctatagcaagctcaccgtggacaagagcaggtggcagcag gggaacgtcttctcatgctccgtgatgcatgaggctctgcacaaccactacacgcagaagagcctctccctgtccccgggtaaatg

```
AA HuIgG1 wild type CH3 (SEQ ID NO: 442)
gqprepqvytlppsreemtknqvsltclvkgfypsdiavewesngqpennykttppvldsdgsfflysk ltvdksrwqqgnvfscsvmhealhnhytqkslslspgk NT HuIgG1 mutated hinge (C—C—C→S—S—S)
(SEQ ID NO: 443)
gatcaggagcccaaatcttctgacaaaactcacacatCcccaccgtcccagca AA HuIgG1 mutated hinge (C—C—C→S—S—S)
(SEQ ID NO: 444)
dqepkssdkthtsppspa Mutant hinge, but wild type CH2 and CH3—reads from the hinge+Ig tail, HIgG1MTH WTCH2CH3:
(SEQ ID NO: 445)
tgatcaccccaaatcttctgacaaaactcacacatctccaccgtcctcagcacctgaactcctgggtggaccg tcagtcttcctcttccccccaaaacccaaggacaccctcatgatctcccggacccctgaggtcacatgcgtggtggtggacgtgag ccacgaagaccctgaggtcaagttcaactggtacgtggacggcgtggaggtgcataatgccaagacaaagccgcgggaggagc agtacaacagcacgtaccgtgtggtcagcgtcctcaccgtcctgcaccaggactggctgaatggcaaggagtacaagtgcaaggt ctccaacaaagcccttcccagcccccatcgagaaaacaatctccaaagccaaagggcagccccgagaaccacaggtgtacaccc tgcccccatcccgggatgagctgaccaagaaccaggtcagcctgacctgcctggtcaaaggcttctatcccagcgacatcgccgt ggagtgggagagcaatgggcagccggagaacaactacaagaccacgcctcccgtgctggactccgacggctcctcttcctcta cagcaagctcaccgtggacaagagcaggtggcagcaggggaacgtcttctcatgctccgtgatgcatgaggctctgcacaacca ctacacgcagaagagcctctccctgtctccgggtaaatgataatctaga Protein sequence: Mutant hinge, but wild type CH2 and CH3
(SEQ ID NO: 446)
dhpkssdkthtsppssapellggpsvflfppkpkdtlmisrtpevtcvvvdvshedpevkfnwyvdgv evhnaktkpreeqynstyrvvsvltvlhqdwlngkeykckvsnkalpapiektiskakgqprepqvytlppsrdeltknqvslt clvkgfypsdiavewesngqpennykttppvldsdgsfflyskltvdksrwqqgnvfscsvmhealhnhytqkslslspgk LLG1-5'bgl 35 mer Llama IgG1 5' (SEQ ID NO: 447)
5'-gtt gtt gat caa gaa cca cat gga gga tgc acg tg-3'

LLG2-5'bgl 32 mer, Llama IgG2-5' (SEQ ID NO: 448)
5'-gtt gtt gat caa gaa ccc aag aca cca aaa cc-3'

LLG3-5'bgl 33 mer, Llama IgG3-5' (SEQ ID NO: 449)
5'-gtt gtt gat caa gcg cac cac agc gaa gac ccc-3'

LLseqsense 19 mer, llama sequencing primer (SEQ ID NO: 450)
5'-ctg aga tcg agt tca gct g-3'

LLseqAS 19 mer (SEQ ID NO: 451)
5'-cct cct ttg gct ttg tct c-3'

NT
2H7 scFv llama IgG1 (SEQ ID NO: 452)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctgagtcc ctgctcgcttcagtggcagtgggtctgggacctcttactctctcacaatcagcagagtggaggctgaagatgctgccacttattactg ccagcagtggagttttaacccaccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaagaaccacatggaggatgcacgtgcctccagtgcccncaat
```

-continued gcccngcnccngaactcccaggaggcccttctgtctttgtcttccccccgaaacccaaggacgtcctctccattttttggaggccga gtcacgtgcgttgtagtggacgtcggaaagaaagaccccgaggtcaatttcaactggtatattgatggcgttgaggtgcgaacggc caatacgaagccaaaagaggaacagttcaacagcacgtaccgcgtggtcagcgtcctgcccatccagcaccaggactggctgac ggggaaggaattcaagtgcaaggtcaacaacaaagctctcccggcccccatcgagaggaccatctccaaggccaaagggcaga cccgggagccgcaggtgtacaccctggccccacaccgggaagaactggccaaggacaccgtgagcgtaacatgcctggtcaa aggcttctacccagctgacatcaacgttgagtggcagaggaacggtcagccggagtcagagggcacctacgccaacacgccgc cacagctggacaacgacgggacctacttcctctacagcaagctctcggtgggaagaacacgtggcagcggggagaaaccttaa cctgtgtggtgatgcatgaggccctgcacaaccactacacccagaaatccatcacccagtcttcgggtaaatagtaatctaga AA 2H7 scFv llama IgG1 (SEQ ID NO: 453)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqephggctcpqcpapelpggpsvfvfppkpkdvlsifggrvtcvvvdvgk kdpevnfnwyidgvevrtantkpkeeqfnstyrvvsvlpiqhqdwltgkefkckvnnkalpapiertiskakgqtrepqvytl aphreelakdtvsvtclvkgfypadinvewqrngqpesegtyantppqldndgtyflysklsvgkntwqrgetltcvvmheal hnhytqksitqssgk NT 2H7 scFv llama IgG2 (SEQ ID NO: 454)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaagaacccaagacaccaaaaccacaaccacaaccacaacca caacccaatcctacaacagaatccaagtgcccaaatgtccagcccctgagctcctgggaggcccctcagtcttcatcttcccccccg aaacccaaggacgtcctctccatttcctgggaggcccgaggtcacgtgcgttgtggtagacgtgggccaggaagaccccgaggtc agtttcaactggtacattgatggcgctgaggtgcgaacggccaacacgaggccaaaagaggaacagttcaacagcacgtaccgc gtggtcagcgtcctgcccatccagcaccaggactggctgacggggaaggaattcaagtgcaaggtcaacaacaaagctctcccg gcccccatcgagaagaccatctccaaggccaaagggcagacccgggagccgcaggtgtacaccctggccccacaccgggaa gagctggccaaggacaccgtgagcgtaacatgcctggtcaaaggcttctacccacctgatatcaacgttgagtggcagaggaatg ggcagccggagtcagagggcacytacgccaccacgccaccccagctggacaacgacgggacctacttcctctacagcaagctc tcggtgggaagaacacgtggcagcagggagaaaccttcacctgtgtggtgatgcacgaggccctgcacaaccactacacccag aaatccatcacccagtcttcgggtaaatagtaatctaga AA
2H7 scFv llama IgG2 (SEQ ID NO: 455)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqktkgkatltvdkssstaymqlssltsedsa vyfcarvvyysnsywyfdvwgtgttvtvssdqepktpkpqpqpqpqpnptteskcpkcpapellggpsvfifppkpkdvlsi -continued sgrpevtcvvvdvgqedpevsfnwyidgaevrtantrpkeeqfnstyrvvsvlpiqhqdwltgkefkckvnnkalpapiekti
skakgqtrepqvytlaphreelakdtvsvtclvkgfyppdinvewqrngqpesegtyattppqldndgtyflysklsvgkntw
qqgetftcvvmhealhnhytqksitqssgk NT
2H7 scFv llama IgG3 (SEQ ID NO: 456)
aagcttgccgccatggattttcaagtgcagattttcagcttcctgctaatcagtgcttcagtcataattgccagag
gacaaattgttctctcccagtctccagcaatcctgtctgcatctccaggggagaaggtcacaatgacttgcagggccagctcaagtg
taagttacatgcactggtaccagcagaagccaggatcctcccccaaaccctggatttatgccccatccaacctggcttctggagtcc
ctgctcgcttcagtggcagtgggtctgggacctcttactctctcacaatcagcagagtggaggctgaagatgctgccacttattactg
ccagcagtggagttttaacccacccacgttcggtgctgggaccaagctggagctgaaagatggcggtggctcgggcggtggtgg
atctggaggaggtgggagctctcaggcttatctacagcagtctggggctgagctggtgaggcctggggcctcagtgaagatgtcct
gcaaggcttctggctacacatttaccagttacaatatgcactgggtaaagcagacacctagacagggcctggaatggattggagct
atttatccaggaaatggtgatacttcctacaatcagaagttcaagggcaaggccacactgactgtagacaaatcctccagcacagcc
tacatgcagctcagcagcctgacatctgaagactctgcggtctatttctgtgcaagagtggtgtactatagtaactcttactggtacttc
gatgtctggggcacagggaccacggtcaccgtctcttctgatcaagcgaaccacagcgaagaccccagctccaagtgtcccaaat
gcccaggccctgaactccttggagggcccacggtcttcatcttccccccgaaagccaaggacgtcctctccatcacccgaaaacct
gaggtcacgtgcttgtggtggacgtgggtaaagaagaccctgagatcgagttcaagctggtccgtggatgacacagaggtacaca
cggctgagacaaagccaaaggaggaacagttcaacagcacgtaccgcgtggtcagcgtcctgcccatccagcaccaggactgg
ctgacggggaaggaattcaagtgcaaggtcaacaacaaagctctcccagcccccatcgagaggaccatctccaaggccaaagg
gcagacccgggagccgcaggtgtacacccctggccccacaccgggaagagctggccaaggacaccgtgagcgtaacctgcctg
gtcaaaggcttcttcccagctgacatcaacgttgagtggcagaggaatgggcagccggagtcagagggcacctacgccaacacg
ccgccacagctggacaacgacgggacctacttcctctacagcaaactctccgtgggaaagaacacgtggcagcagggagaagt
cttcacctgtgtggtgatgcacgaggctctacacaatcactccacccagaaatccatcacccagtcttcgggtaaatagtaatctaga
gggccc AA
2H7 scFv llama IgG3 (SEQ ID NO: 457)
mdfqvqifsfllisasviiargqivlsqspailsaspgekvtmtcrasssvsymhwyqqkpgsspkpwiy
apsnlasgvparfsgsgsgtsysltisrveaedaatyycqqwsfnpptfgagtklelkdgggsggggsggggssqaylqqsgae
lvrpgasvkmsckasgytftsynmhwvkqtprqglewigaiypgngdtsynqkfkgkatltvdkssstaymqlssltsedsa
vyfcarvvyysnsywyfdvwgtgttvtvssdqahshsedpsskcpkcpgpellggptvfifppkakdvlsitrkpevtclwwt
wvkktlrsssswsvddtevhtaetkpkeeqthstyrvvsvlpiqhqdwltgkefkckvnnkalpapiertiskakgqtrepqv
ytlaphreelakdtvsvtclvkgffpadinvewqrngqpesegtyantppqldndgtyflysklsvgkntwqqgevftcvvm
healhnhstqksitqssgk 2H7+Completely WT IgG tail:
2H7 scFv WTH WTCH2CH3
(SEQ ID NO: 458)
Nucleotide sequence:

aagcttgccgccatggattttcaagtgcagattttcagcttcctgctaatcagtgcttcagtcataattgccagag
gacaaattgttctctcccagtctccagcaatcctgtctgcatctccaggggagaaggtcacaatgacttgcagggccagctcaagtg
taagttacatgcactggtaccagcagaagccaggatcctcccccaaaccctggatttatgccccatccaacctggcttctggagtcc
ctgctcgcttcagtggcagtgggtctgggacctcttactctctcacaatcagcagagtggaggctgaagatgctgccacttattactg
ccagcagtggagttttaacccacccacgttcggtgctgggaccaagctggagctgaaagatggcggtggctcgggcggtggtgg
atctggaggaggtgggagctctcaggcttatctacagcagtctggggctgagctggtgaggcctggggcctcagtgaagatgtcct
gcaaggcttctggctacacatttaccagttacaatatgcactgggtaaagcagacacctagacagggcctggaatggattggagct

```
atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttgtgacaaaactcacacatgcccaccgtg cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagcccctcccagcccccatcgagaaaacaatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga
```
2H7+Completely WT IgG tail:  
2H7 scFv WTH WTCH2CH3  
(SEQ ID NO: 459)  
Protein sequence

```
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqktkgkatltvdkssstaymqlssltsedsa vyfcarvvyysnsywyfdvwgtgttvtvssdqepkscdkthtcppcpapellggpsvflfppkpkdtlmisrtpevtcvvvd vshedpevkfnwyvdgvevhnaktkpreeqynstyrvvsvltvlhqdwlngkeykckvsnkalpapiektiskakgqpre pqvytlppsrdeltknqvsltclvkgfypsdiavewesngqpennykttppvldsdgsfflysklkvdksrwqqgnvfscsvm healhnhytqkslslspgk
```
NT  
CD80 transmembrane domain and cytoplasmic tail (+restriction sites)  
(SEQ ID NO: 460)  
```
gcggatccttcgaacctgctcccatcctgggccattaccttaatctcagtaaatggaattttttgtgatatgctgcc tgacctactgctttgccccaagatgcagagagagaaggaggaatgagagattgagaagggaaagtgtacgccctgtataaatcga t
```
AA  
CD80 transmembrane domain and cytoplasmic tail  
(SEQ ID NO: 461)  
```
adpsnllpswaitlisvngifviccltycfaprcrerrrnerlrresvrpv
```
NT  
40.2.220 VL (anti-human CD40 scFv #1--VL)  
(SEQ ID NO: 462)  
```
aagcttatggattttcaagtgcagattttcagcttcctgctaatcagtgcttcagtcataatgtccagaggagtcg acattgttctgactcagtctccagccaccctgtctgtgactccaggagatagagtctctctttcctgcagggccagccagagtattagc gactacttacactggtatcaacaaaaatcacatgagtctccaaggcttctcatcaaatatgcttcccattccatctctgggatccctcc aggttcagtggcagtggatcagggtcagatttcactctcagtatcaacagtgtggaacctgaagatgttggaatttattactgtcaaca tggtcacagctttccgtggacgttcggtggaggcaccaagctggaaatcaaacgg
```
AA  
40.2.220 VL (anti-human CD40 scFv #1--VL)  
(SEQ ID NO: 463)  
```
mdfqvqifsfllisasvimsrgvdivltqspatlsvtpgdrvslscrasqsisdylhwyqqkshesprlliky ashsisgipsrfsgsgsgsdftlsinsvepedvgiyycqhghsfpwtfgggtkleikr
```
NT  
40.2.220 VH (for anti-human CD40 scFv #1--VH)  
(SEQ ID NO: 464)  
```
cagatccagttggtgcaatctggacctgagctgaagaagcctggagagacagtcaggatctcctgcaaggc
```

-continued ttctgggtatgccttcacaactactggaatgcagtgggtgcaagagatgccaggaaagggtttgaagtggattggctggataaacac cccactctggagtgccaaaatatgtagaagacttcaaggacggtttgccttctctttggaaacctctgccaacactgcatatttacaga taagcaacctcaaagatgaggacacggctacgtatttctgtgtgagatccgggaatggtaactatgacctggcctactttgcttactg gggccaagggacactggtcactgtctctgatca AA
40.2.220 VH (for anti-human CD40 scFv #1--VH)
(SEQ ID NO: 465)
qiqlvqsgpelkkpgctvrisckasgyaftttgmqwvqempgkglkwigwintplwsakicrrlqgrfa fsletsantaylqisnlkdedtatyfcvrsgngnydlayfaywgqgtlvtvs NT
40.2.220 scFv (anti-human CD40 scFv #1)
(SEQ ID NO: 466)
aagcttatggattttcaagtgcagattttcagcttcctgctaatcagtgcttcagtcataatgtccagaggagtcg acattgttctgactcagtctccagccaccctgtctgtgactccaggagatagagtctctctttcctgcagggccagccagagtattagc gactacttacactggtatcaacaaaaatcacatgagtctccaaggcttctcatcaaatatgcttcccattccatctctgggatcccctcc aggttcagtggcagtggatcagggtcagatttcactctcagtatcaacagtgtggaacctgaagatgttggaatttattactgtcaaca tggtcacagcttccgtggacgttcggtggaggcaccaagctggaaatcaaacggggtggcggtggctcgggcggaggtgggtc gggtggcggcggatctcagatccagttggtgcaatctggacctgagctgaagaagcctggagagacagtcaggatctcctgcaa ggcttctgggtatgccttcacaactactggaatgcagtgggtgcaagagatgccaggaaagggtttgaagtggattggctggataa acaccccactctggagtgccaaaatatgtagaagacttcaaggacggtttgccttctctttggaaacctctgccaacactgcatattta cagataagcaacctcaaagatgaggacacggctacgtatttctgtgtgagatccgggaatggtaactatgacctggcctactttgctt actggggccaagggacactggtcactgtctctgatca AA
40.2.220 scFv (anti-human CD40 scFv #1)
(SEQ ID NO: 467)
mdfqvqifsfllisasvimsrgvdivltqspatlsvtpgdrvslscrasqsisdylhwyqqkshesprlliky ashsisgipsrfsgsgsgsdftlsinsvepedvgiyycqhghsfpfgggtkleikrggggsggggsggggsqiqlvqsgpel kkpgctvrisckasgyaftttgmqwvqempgkglkwigwintplwsakicrrlqgrfafsletsantaylqisnlkdedtatyfc vrsgngnydlayfaywgqgtlvtvs NT
2e12 VL (with L6 VK leader peptide)
(SEQ ID NO: 468)
atggattttcaagtgcagattttcagcttcctgctaatcagtgcttcagtcataatgtccagaggagtcgacattg tgctcacccaatctccagcttctttggctgtgtctctaggtcagagagccaccatctcctgcagagccagtgaaagtgttgaatattat gtcacaagtttaatgcagtggtaccaacagaaaccaggacagccacccaaactcctcatctctgctgcatccaacgtagaatctgg ggtccctgccaggtttagtggcagtgggtctgggacagacttcagcctcaacatccatcctgtggaggaggatgatattgcaatgta tttctgtcagcaaagtaggaaggttccttggacgttcggtggaggcaccaagctggaaatcaaacgg AA
2e12 VL (with L6 VK leader peptide)
(SEQ ID NO: 469)
mdfqvqifsfllisasvimsrgvdivltqspaslavslgqratiscrasesveyyvtslmqwyqqkpgqp pkllisaasnvesgvparfsgsgsgtdfslnihpveeddiamyfcqqsrkvpwtfgggtkleikr NT
2e12 VH (no leader peptide)
(SEQ ID NO: 470)
caggtgcagctgaaggagtcaggacctggcctggtggcgccctcacagagcctgtccatcacatgcaccg tctcagggttctcattaaccggctatggtgtaaactgggttcgccagcctccaggaaagggtctggagtggctgggaatgatatggg gtgatgggaagcacagactataattcagctctcaaatccagactgagcatcaccaaggacaactccaagagccaagttttcttaaaaa tgaacagtctgcaaactgatgacacagccagatactactgtgccagagatggttatagtaactttcattactatgttatggactactgg ggtcaaggaacctcagtcaccgtctcctca(gatctg)

AA
2e12 VH
(SEQ ID NO: 471)
qvqlkesgpglvapsqslsitctvsgfsltgygvnwvrqppgkglewlgmiwdgstdynsalksrlsit kdnsksqvflkmnslqtddtaryycardgysnthyyvmdywgqgtsvtvss NT
2e12scFv(+Restriction sites)
(SEQ ID NO: 472)

aagcttatggattttcaagtgcagattttcagcttcctgctaatcagtgcttcagtcataatgtccagaggagtcg acattgtgctcacccaatctccagcttctttggctgtgtctctaggtcagagagccaccatctcctgcagagccagtgaaagtgttgaa tattatgtcacaagtttaatgcagtggtaccaacagaaaccaggacagcacccaaactcctcatctctgctgcatccaacgtagaat ctggggtccctgccaggtttagtggcagtgggtctgggacagacttcagcctcaacatccatcctgtggaggaggatgatattgcaa tgtatttctgtcagcaaagtaggaaggttccttggacgttcggtggaggcaccaagctggaaatcaaacggggtggcggtggctcg ggcggaggtgggtcgggtggcggcggatctcaggtgcagctgaaggagtcaggacctggcctggtggcgccctcacagagcc tgtccatcacatgcaccgtctcagggttctcattaaccggctatggtgtaaactgggttcgccagcctccaggaaagggtctggagt ggctgggaatgatatgggtgatggaagcacagactataattcagctctcaaatccagactgagcatcaccaaggacaactccaa gagccaagttttcttaaaaatgaacagtctgcaaactgatgacacagccagatactactgtgccagagatggttatagtaactttcatt actatgttatggactactggggtcaaggaacctcagtcaccgtctcctct(gatcag)

AA
2e12scFv
(SEQ ID NO: 473)
mdfqvqifsfllisasvimsrgvdivltqspaslavslgqratiscrasesveyyvtslmqwyqqkpgqp pkllisaasnvesgvparfsgsgsgtdfslnihpveeddiamyfcqqsrkvpwtfggtkleikrggggsggggsggggsqvq lkesgpglvapsqslsitctvsgfsltgygvnwvrqppgkglewlgmiwdgstdynsalksrlsitkdnsksqvflkmnslqt ddtaryycardgysnfhyyvmdywgqgtsvtvss 10A8 is anti-CD 152 (CTLA-4)
10A8 VL (with L6 VK leader peptide)
(SEQ ID NO: 474)
atggattttcaagtgcagattttcagcttcctgctaatcagtgcttcagtcataatgtccagaggagtcgacatcc agatgacacagtctccatcctcactgtctgcatctctgggaggcaaagtcaccatcacttgcaaggcaagccaagacattaagaagt atataggttggtaccaacacaagcctggaaaaggtcccaggctgctcatatattacacatctacattacagccaggcatcccatcaa ggttcagtggaagtgggtctgggagagattattccctcagcatcagaaacctggagcctgaagatattgcaacttattattgtcaaca gtatgataatcttccattgacgttcggctcggggacaaagttggaaataaaacgg AA
10A8 VL
(SEQ ID NO: 475)
mdfqvqifsfllisasvimsrgvdiqmtqspsslsaslggkvtitckasqdikkyigwyqhkpgkgprlli yytstlqpgipsrfsgsgsgrdyslsirnlepediatyycqqydnlpltfgsgtkleikr NT
10A8 VH (no leader peptide)
(SEQ ID NO: 476)
gatgtacagcttcaggagtcaggacctggcctcgtgaaaccttctcagtctctgtctctcacctgctctgtcact ggctactccatcaccagtggtttctactggaactggatccgacagtttccgggaaacaaactggaatggatgggccacataagcca cgacggtaggaataactacaacccatctctcataaatcgaatctccatcactcgtgacacatctaagaaccagttttcctgaagttga gttctgtgactactgaggacacagctacatatttctgtgcaagacactacggtagtagcggagctatggactactggggtcaaggaa cctcagtcaccgtctcctctgatca

AA
10A8 VH (SEQ ID NO: 477)
dvqlqesgpglvkpsqslsltcsvtgysitsgfywnwirqfpgnklewmghishdgrnnynpslinrisi trdtsknqffklssvttedtatyfcarhygssgamdywgqgtsvtvss NT
10A8 scFv
(SEQ ID NO: 478)
aagcttatggattttcaagtgcagattttcagcttcctgctaatcagtgcttcagtcataatgtccagaggagtcg acatccagatgacacagtctccatcctcactgtctgcatctctggaggcaaagtcaccatcacttgcaaggcaagccaagacatta agaagtatataggttggtaccaacacaagcctggaaaaggtcccaggctgctcatatattacacatctacattacagccaggcatcc catcaaggttcagtggaagtgggtctgggagagattattccctcagcatcagaaacctggagcctgaagatattgcaacttattattgt caacagtatgataatcttccattgacgttcggctcggggacaaagttggaaataaaacggggtggcggtggctcgggcggtggtg ggtcgggtggcggcggatctgatgtacagcttcaggagtcaggacctggcctcgtgaaaccttctcagtctctgtctctcacctgctc tgtcactggctactccatcaccagtggtttctactggaactggatccgacagtttccgggaaacaaactggaatggatgggccacat aagccacgacggtaggaataactacaaccccatctctcataaatcgaatctccatcactcgtgacacatctaagaaccagttttttcctga agttgagttctgtgactactgaggacacagctacatatttctgtgcaagacactacggtagtagcggagctatggactactggggtca aggaacctcagtcaccgtctcctctgatca AA
10A8 scFv
(SEQ ID NO: 479)
mdfqvqifsfllisasvimsrgvdiqmtqspsslsaslggkvtitckasqdikkyigwyqhkpgkgprlli yytstlqpgipsrfsgsgsgrdyslsirnlepediatyycqqydnlpltfgsgtkleikrggggsggggsggggsdvqlqesgpgl vkpsqslsltcsvtgysitsgfywnwirqfpgnklewmghishdgrnnynpslinrisitrdtsknqfflklssvttedtatyfcar hygssgamdywgqgtsvtvssd NT
40.2.220-hmtIgG1-hCD80
(SEQ ID NO: 480)
aagcttatggattttcaagtgcagattttcagcttcctgctaatcagtgcttcagtcataatgtccagaggagtcg acattgttctgactcagtctccagccaccctgtctgtgactccaggagatagagtctctctttcctgcagggccagccagagtattagc gactacttacactggtatcaacaaaaatcacatgagtctccaaggcttctcatcaaatatgcttcccattccatctctgggatccctcc aggttcagtggcagtggatcagggtcagatttcactctcagtatcaacagtgtggaacctgaagatgttggaatttattactgtcaaca tggtcacagcttccgtggacgttcggtggaggcaccaagctggaaatcaaacggggtggcggtggctcgggcggaggtgggtc gggtggcggcggatctcagatccagttggtgcaatctggacctgagctgaagaagcctggagagacagtcaggatctcctgcaa ggcttctgggtatgccttcacaactactggaatgcagtgggtgcaagagatgccaggaaagggtttgaagtggattggctggataa acacccactctggagtgccaaatatgtagaagacttcaaggacgtttgccttctctttggaaacctctgccaacactgcatattta cagataagcaacctcaaagatgaggacacggctacgtatttctgtgtgagatccgggaatggtaactatgacctggcctactttgctt actggggccaagggacactggtcactgtctctgatctggagcccaaatcttctgacaaaactcacacatccccaccgtccccagca cctgaactcctgggggatcgtcagtcttcctcttccccccaaaacccaaggacaccctcatgatctcccggacccctgaggtcac atgcgtggtggtggacgtgagccacgaagaccctgaggtcaagttcaactggtacgtggacggcgtggaggtgcataatgccaa gacaaagccgcgggaggagcagtacaacagcacgtaccgtgtggtcagcgtcctcaccgtcctgcaccaggactggctgaatg gcaaggagtacaagtgcaaggtctccaacaaagcccctcccagcccccatcgagaaaaccatctccaaagccaaagggcagccc cgagaaccacaggtgtacaccctgcccccatcccgggatgagctgaccaagaaccaggtcagcctgacctgcctggtcaaaggc ttctatcccagcgacatcgccgtggagtgggagagcaatgggcagccggagaacaactacaagaccacgcctcccgtgctggac tccgacggctccttcttcctctacagcaagctcaccgtggacaagagcaggtggcagcaggggaacgtcttctcatgctccgtgat gcatgaggctctgcacaaccactacacgcagaagagcctctccctgtctccgggtaaagcggatccttcgaacctgctcccatcct gggccattacccttaatctcagtaaatggaattttttgtgatatgctgcctgacctactgctttgccccaagatgcagagagagaaggag

```
                                 -continued
gaatgagagattgagaagggaaagtgtacgccctgtataaatcgat
```

AA
40.2.220-hmtIgG1-hCD80
(SEQ ID NO: 481)
mdfqvqifsfllisasvimsrgvdivltqspatlsvtpgdrvslscrasqsisdylhwyqqkshesprlliky ashsisgipsrfsgsgsgsdftlsinsvepedvgiyycqhghsfpwtfggtkleikrggggsggggsggggsqiqlvqsgpel kkpgetvrisckasgyaftttgmqwvqempgkglkwigwintplwsakicrrlqgrfafsletsantaylqislkdedtatyfc vrsgngnydlayfaywgqgtlvtvsdlepkssdkthtsppspapellggssvflfppkpkdtlmisrtpevtcvvvdvshedpe vkfhwyvdgvevhnaktkpreeqynstyrvvsvltvlhqdwlngkeykckvsnkalpapiektiskakgqprepqvytlpp srdeltknqvsltclvkgfypsdiavewesngqpennyktttppvldsdgsfflyskltvdksrwqqgnvfscsvmhealhnhy tqkslslspgkadpsnllpswaitlisvngifviccltycfaprcrerrrnerlrresvrpv NT
2e12scFv- hmtIgG1-CD80 fusion protein
(SEQ ID NO: 482)
```
aagcttatggattttcaagtgcagattttcagcttcctgctaatcagtgcttcagtcataatgtccagaggagtcg acattgtgctcacccaatctccagcttctttggctgtgtctctaggtcagagagccaccatctcctgcagagccagtgaaagtgttgaa tattatgtcacaagtttaatgcagtggtaccaacagaaaccaggacagccacccaaactcctcatctctgctgcatccaacgtagaat ctggggtccctgccaggtttagtggcagtgggtctgggacagacttcagcctcaacatccatcctgtggaggaggatgatattgcaa tgtatttctgtcagcaaagtaggaaggttccttggacgttcggtggaggcaccaagctggaaatcaaacggggtggcggtggctcg ggcggaggtgggtcgggtggcggcggatctcaggtgcagctgaaggagtcaggacctggcctggtggcgccctcacagagcc tgtccatcacatgcaccgtctcagggttctcattaaccggctatggtgtaaactgggttcgccagcctccaggaaagggtctggagt ggctgggaatgatatggggtgatggaagcacagactataattcagctctcaaatccagactgagcatcaccaaggacaactccaa gagccaagttttcttaaaaatgaacagtctgcaaactgatgacacagccagatactactgtgccagagatggttatagtaactttcatt actatgttatggactactggggtcaaggaacctcagtcaccgtctcctcagatctggagcccaaatcttctgacaaaactcacacatc cccaccgtcccagcacctgaactcctggggggatcgtcagtcttcctcttccccccaaaacccaaggacaccctcatgatctccc ggaccctgaggtcacatgcgtggtggtggacgtgagccacgaagaccctgaggtcaagttcaactggtacgtggacggcgtgg aggtgcataatgccaagacaaagccgcgggaggagcagtacaacagcacgtaccgtgtggtcagcgtcctcaccgtcctgcacc aggactggctgaatggcaaggagtacaagtgcaaggtctccaacaaagcccctcccagcccccatcgagaaaaccatctccaaag ccaaagggcagccccgagaaccacaggtgtacaccctgcccccatcccgggatgagctgaccaagaaccaggtcagcctgacc tgcctggtcaaaggcttctatcccagcgacatcgccgtggagtgggagagcaatgggcagccggagaacaactacaagaccac gcctcccgtgctggactccgacggctccttcttcctctacagcaagctcaccgtggacaagagcaggtggcagcaggggaacgtc ttctcatgctccgtgatgcatgaggctctgcacaaccactacacgcagaagagcctctccctgtctccgggtaaagcggatccttcg aacctgctcccatcctgggccattaccttaatctcagtaaatggaatttttgtgatatgctgcctgacctactgctttgccccaagatgca gagagagaaggaggaatgagagattgagaagggaaagtgtacgccctgtataaatcgat
```

AA
2e12scFv- hmtIgG1-CD80 fusion protein
(SEQ ID NO: 483)
mdfqvqifsfflisasvimsrgvdivltqspaslavslgqratiscrasesveyyvtslmqwyqqkpgqp pkllisaasnvesgvparfsgsgsgtdfslnihpveeddiamyfcqqsrkvpwtfgggtkleikrggggsggggsggggsqvq lkesgpglvapsqslsitctvsgfsltgygvnwvrqppgkglewlgmiwgdgstdynsalksrlsitkdnsksqvflkmfslqt ddtaryycardgysnfhyyvmdywgqgtsvtvssdlepkssdkthtsppspapellggssvflfppkpkdtlmisrtpevtcv vvdvshedpevkfhwyvdgvevhnaktkpreeqynstyrvvsvltvlhqdwlngkeykckvsnkalpapiektiskakgq prepqvytlppsrdeltknqvsltclvkgfypsdiavewesngqpennyktttppvldsdgsfflyskltvdksrwqqgnvfscs vmhealhnhytqkslslspgkadpsnllpswaitlisvngifviccltycfaprcrerrrnerlrresvrpv

NT

10A8 scFv-hmtIgG1-CD80
(SEQ ID NO: 484)
aagcttatggattttcaagtgcagattttcagcttcctgctaatcagtgcttcagtcataatgtccagaggagtcg acatccagatgacacagtctccatcctcactgtctgcatctctgggaggcaaagtcaccatcacttgcaaggcaagccaagacatta agaagtatataggttggtaccaacacaagcctggaaaaggtcccaggctgctcatatattacacatctacattacgccaggcatcc catcaaggttcagtggaagtgggtctgggagagattattccctcagcatcagaaacctggagcctgaagatattgcaacttattattgt caacagtatgataatcttccattgacgttcggctcggggacaaagttggaaataaaacggggtggcggtggctcgggcggtggtg ggtcgggtggcggcggatctgatgtacagcttcaggagtcaggacctggcctcgtgaaaccttctcagtctctgtctctcacctgctc tgtcactggctactccatcaccagtggttttctactggaactggatccgacagtttccgggaaacaaactggaatggatgggccacat aagccacgacggtaggaataactacaacccatctctcataaatcgaatctccatcactcgtgacacatctaagaaccagttttttcctga agttgagttctgtgactactgaggacacagctacatatttctgtgcaagacactacggtagtagcggagctatggactactggggtca aggaacctcagtcaccgtctcctctgatctggagcccaaatcttctgacaaaactcacacatccccaccgtcccagcacctgaact cctggggggatcgtcagtcttcctcttccccccaaaacccaaggacaccctcatgatctcccggacccctgaggtcacatgcgtgg tggtggacgtgagccacgaagaccctgaggtcaagttcaactggtacgtggacggcgtggaggtgcataatgccaagacaaagc cgcgggaggagcagtacaacagcacgtaccgtgtggtcagcgtcctcaccgtcctgcaccaggactggctgaatggcaaggagt acaagtgcaaggtctccaacaaagccctcccagcccccatcgagaaaaccatctccaaagccaaagggcagccccgagaacca caggtgtacaccctgcccccatcccgggatgagctgaccaagaaccaggtcagcctgacctgcctggtcaaaggcttctatccca gcgacatcgccgtggagtgggagagcaatgggcagccggagaacaactacaagaccacgcctcccgtgctggactccgacgg ctccttcttcctctacagcaagctcaccgtggacaagagcaggtggcagcaggggaacgtcttctcatgctccgtgatgcatgagg ctctgcacaaccactacacgcagaagagcctctccctgtctccgggtaaagcggatccttcgaacctgctcccatcctgggccatta ccttaatctcagtaaatggaattttttgtgatatgctgcctgacctactgctttgccccaagatgcagagagagaaggaggaatgagag attgagaagggaaagtgtacgccctgtataaatcgat AA
10A8 scFv-hmtIgG1-CD80
(SEQ ID NO: 485)
mdfqvqifsfllisasvimsrgvdiqmtqspsslsaslggkvtitckasqdikkyigwyqhkpgkgprlli yytstlqpgipsrfsgsgsgrdyslsirnlepediatyycqqydnlpltfgsgtkleikrggggsggggsggggsdvqlqesgpgl vkpsqslsltcsvtgysitsgfywnwirqfpgnklewmghishdgrnnynpslinrisitrdtsknqfflklssvttedtatyfcar hygssgamdywgqgtsvtvssdlepkssdkthtsppspapellggssvflfppkpkdtlmisrtpevtcvvvdvshedpevk fnwyvdgvevhnaktkpreeqynstyrvvsvltvlhqdwlngkeykckvsnkalpapiektiskakgqprepqvytlppsr deltknqvsltclvkgfypsdiavewesngqpennykttppvldsdgsfflysklvdksrwqqgnvfscsvmhealhnhyt qkslslspgkadpsnllpswaitlisvngifviccltycfaprcrerrrnerlrresvrpv NT
500A2-hmtIgG1-CD80
(SEQ ID NO: 486)
atgttgtatacatctcagctccttgggctttactcttctggatttcagcctccagaagtgacatagtgctgactca gactccagccactctgtctctaattcctggagaaagagtcacaatgacctgtaagaccagtcagaatattggcacaatcttacactgg tatcaccaaaaaccaaaggaggctccaagggctctcatcaagtatgcttcgcagtccattcctgggatcccctccagattcagtggc agtggttcggaaacagatttcactctcagcatcaataacctggagcctgatgatatcggaatttattactgtcaacaaagtagaagctg gcctgtcacgttcggtcctggcaccaagctggagataaaacggggtggcggtggctcgggcggaggtgggtcgggtggcggcg gatctcaggtcaagctgcagcagtccggttctgaactagggaaacctggggcctcagtgaaactgtcctgcaagacttcaggctac atattcacagatcactatatttcttgggtgaaacagaagcctggagaaagcctgcagtggataggaaatgtttatggtggaaatggtg gtacaagctacaatcaaaaattccagggcaaggccacactgactgtagataaatctctagcacagcctacatggaactcagcagc ctgacatctgaggattctgccatctattactgtgcaagaaggccggtagcgacgggccatgctatggactactggggtcaggggat -continued

```
ccaagttaccgtctcctctgatctggagcccaaatcttctgacaaaactcacacatccccaccgtccccagcacctgaactcctggg gggatcgtcagtcttcctcttccccccaaaacccaaggacaccctcatgatctcccggacccctgaggtcacatgcgtggtggtgg acgtgagccacgaagaccctgaggtcaagttcaactggtacgtggacggcgtggaggtgcataatgccaagacaaagccgcgg gaggagcagtacaacagcacgtaccgtgtggtcagcgtcctcaccgtcctgcaccaggactggctgaatggcaaggagtacaag tgcaaggtctccaacaaagcccttcccagcccccatcgagaaaaccatctccaaagccaaagggcagccccgagaaccacaggt gtacaccctgcccccatcccgggatgagctgaccaagaaccaggtcagcctgacctgcctggtcaaaggcttctatcccagcgac atcgccgtggagtgggagagcaatgggcagccggagaacaactacaagaccacgcctcccgtgctggactccgacggctcctt cttcctctacagcaagctcaccgtggacaagagcaggtggcagcaggggaacgtcttctcatgctccgtgatgcatgaggctctgc acaaccactacacgcagaagagcctctccctgtctccgggtaaagcggatccttcgaacctgctcccatcctgggccattaccttaa tctcagtaaatggaattttttgtgatatgctgcctgacctactgctttgccccaagatgcagagagagaaggaggaatgagagattgag aagggaaagtgtacgccctgtataaatcgat
```

AA
500A2-hmtIgG1-CD80
(SEQ ID NO: 487)
mlytsqllglllfwisasrsdivltqtpatlslipgervtmtcktsqnigtilhwyhqkpkeapralikyasqsi pgipsrfsgsgsetdftlsinnlepddigiyycqqsrswpvtfgpgtkleikrggggsggggsggggsqvklqqsgselgkpga svklscktsgyiftdhyiswvkqkpgeslqwignvyggnggtsynqkfqgkatltvdkisstaymelssltsedsaiyycarrp vatghamdywgqgiqvtvssdlepkssdkthtsppspapellggssvflfppkpkdtlmisrtpevtcvvvdvshedpevkf nwyvdgvevhnaktkpreeqynstyrvvsvltvlhqdwlngkeykckvsnkalpapiektiskakgqprepqvytlppsrd eltknqvsltclvkgfypsdiavewesngqpennykttppvldsdgsfflyskltvdksrwqqgnvfscsvmhealhnhytq kslslspgkadpsnllpswaitlisvngifviccltycfaprcrerrrnerlrresvrpv NT
2H7 scFv MTH(SSS)WTCH2CH3
(SEQ ID NO: 488)
```
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcggggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatccccaccgtc cccagcacctgaactcctgggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagcccttcccagcccccatcgagaaaaccatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga 2H7 scFv MTH(SSS)WTCH2CH3 protein sequence
(SEQ ID NO: 489):

-continued mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvmh ealhnhytqkslslspgk HuIgGMHncs1 (oligo for Css)
(SEQ ID NO: 490)
gtt gtt gat cag gag ccc aaa tct tgt gac aaa act cac HuIgGMHncs2 (oligo for sCs=ncs2)
(SEQ ID NO: 491)
gtt gtt gat cag gag ccc aaa tct tct gac aaa act cac aca tgc cca ccg HuIgGMHncs3 (oligo for ssC=ncs3)
(SEQ ID NO: 492)
gtt gtt gat cag gag ccc aaa tct tct gac aaa act cac aca tct cca ccg tgc cca gca cct g hIgGWT3xba (3' oligo for above mutation introduction)
(SEQ ID NO: 493)
gtt gtt tct aga tca ttt acc cgg aga cag gga gag gct ctt ctg cgt gta g Vhser11: (oligo for Leu to ser at VH11)
(SEQ ID NO: 494)
gga ggt ggg agc tct cag gct tat cta cag cag tct ggg gct gag tcg gtg agg cc huIgG1-3' (3' oligo to amplify IgG1C regions, 3' end of CH3)
(SEQ ID NO: 495)
gtc tct aga cta tca ttt acc cgg aga cag huIgA/Gchim5 (oligo for pcr#1)
(SEQ ID NO: 496)
cca tct ccc tca act cca cct acc cca tct ccc tca tgc gca cct gaa ctc ctg huIgAhg-5' (oligo for pcr#2)
(SEQ ID NO: 497)
gtt gtt gat cag cca gtt ccc tca act cca cct acc cca tct ccc caa ct huIgA3'
(SEQ ID NO: 498)
gtt gtt tct aga tta tca gta gca ggt gcc gtc cac ctc cgc cat gac aac 2H7 scFv IgAH IGG WT CH2CH3, 2H7 scFv with IgA hinge and WT
CH2 and CH3
(SEQ ID NO: 499)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctctgatcagccagttccctcaactccacctaccccatctccctcaactccacct accccatctccctcatgcgcacctgaactcctgggggaccgtcagtcttcctcttccccccaaaacccaaggacaccctcatgatc tcccggacccctgaggtcacatgcgtggtggtggacgtgagccacgaagaccctgaggtcaagttcaactggtacgtggacggc gtggaggtgcataatgccaagacaaagccgcgggaggagcagtacaacagcacgtaccgtgtggtcagcgtcctcaccgtcctg -continued caccaggactggctgaatggcaaggagtacaagtgcaaggtctccaacaaagccctcccagcccccatcgagaaaacaatctcc aaagccaaagggcagccccgagaaccacaggtgtacaccctgcccccatcccgggatgagctgaccaagaaccaggtcagcct gacctgcctggtcaaaggcttctatcccagcgacatcgccgtggagtgggagagcaatgggcagccggagaacaactacaaga ccacgcctcccgtgctggactccgacggctccttcttcctctacagcaagctcaccgtggacaagagcaggtggcagcaggga acgtcttctcatgctccgtgatgcatgaggctctgcacaaccactacacgcagaagagcctctccctgtctccgggtaaatgatctag a 2H7 scFv IgAH IGG WT CH2CH3 protein sequence
(SEQ ID NO: 500)
mdfqvqifsfllisasviiargqivlsqspailsaspgekvtmterasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvsdqpvpstpptpspstpptpspscapellggpsvflfppkpkdtlmisrtpevtcv vvdvshedpevkfnwyvdgvevhnaktkpreeqynstyrvvsvltvlhqdwlngkeykckvsnkalpapiektiskakgq prepqvytlppsrdeltknqvsltclvkgfypsdiavewesngqpennykttppvldsdgsfflysklltvdksrwqqgnvfscs vmhealhnhytqkslslspgk NT
2H7 scFv IgAH IgACH2CH3 (2H7 scFv IgAhinge and IgA CH2 and CH3)
(SEQ ID NO: 501)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggctctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcagccagttccctcaactccacctaccccatctccctcaactcca cctaccccatctccctcatgctgccaccccgactgtcactgcaccgaccggccctcgaggacctgctcttaggttcagaagcgat cctcacgtgcacactgaccggcctgagagatgcctcaggtgtcaccttcacctggacgccctcaagtgggaagagcgctgttcaa ggaccacctgaccgtgacctctgtggctgctacagcgtgtccagtgtcctgccgggctgtgccgagccatggaaccatgggaaga ccttcacttgcactgctgcctaccccgagtccaagaccccgctaaccgccaccctctcaaaatccggaaacacattccggcccgag gtccacctgctgccgccgccgtcggaggagctggccctgaacgagctggtgacgctgacgtgcctggcacgtggcttcagcccc aaggatgtgctggttcgctggctgcaggggtcacaggagctgccccgcgagaagtacctgacttgggcatcccggcaggagccc agccagggcaccaccaccttcgctgtgaccagcatactgcgcgtggcagccgaggactggaagaagggggacaccttctcctg catggtgggccacgaggccctgccgctggccttcacacagaagaccatcgaccgcttggcgggtaaacccacccatgtcaatgt gtctgttgtcatggcggaggtggacggcacctgctactgataatctaga AA
2H7 scFv IgAH IgACH2CH3 (2H7 scFv IgA hinge and IgA CH2 and CH3)
(SEQ ID NO: 502)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqpvpstpptpspstpptpspscchprlslhrpaledllllgseailtctltglrdas -continued gvtftwtpssgksavqgppdrdlcgcysvssvlpgcaepwnhgktftctaaypesktpltatlskgsflttitpevhllpppseelal nelvtltclargfspkdvlvrwlqgsqelprekyltwasrqepsqgttttfavtsilrvaaedwkkgdtfscmvghealplaftqkti drlagkpthvnvsvvmaevdgtcy IgA hinge-CH2—CH3 (Human IgA tail, full length)
(SEQ ID NO: 503)
tgatcagccagttccctcaactccacctaccccatctccctcaactccacctacccatctccctcatgctgcc accccgactgtcactgcaccgaccggccctcgaggacctgctcttaggttcagaagcgatcctcacgtgcacactgaccggcct gagagatgcctcaggtgtcaccttcacctggacgccctcaagtgggaagagcgctgttcaaggaccacctgaccgtgacctctgt ggctgctacagcgtgtccagtgtcctgccgggctgtgccgagccatggaaccatgggaagaccttcacttgcactgctgcctaccc cgagtccaagaccccgctaaccgccaccctctcaaaatccggaaacacattccggcccgaggtccacctgctgccgccgccgtc ggaggagctggcccgaacgagctggtgacgctgacgtgcctggcacgtggcttcagccccaaggatgtgctggttcgctggct gcaggggtcacaggagctgccccgcgagaagtacctgacttgggcatcccggcaggagcccagccagggcaccaccaccttc gctgtgaccagcatactgcgcgtggcagccgaggactggaagaaggggggacaccttctcctgcatggtgggccacgaggccct gccgctggccttcacacagaagaccatcgaccgcttggcgggtaaacccacccatgtcaatgtgtctgttgtcatggcggaggtgg acggcacctgctactgataatctaga IgA hinge-CH2—CH3 Protein sequence, (Human IgA tail, full length)
(SEQ ID NO: 504)
Dqpvpstpptpspstpptpspscchprlslhrpaledllllgseailtctltglrdasgvtftwtpssgksavqg ppdrdlcgeysvssvlpgcaepwnhgktftctaaypesktpltatlskgsgntfrpevhllpppseelalnelvtltelargfspkdvl vrwlqgsqelprekyltwasrqepsqgttttfavtsilrvaaedwkkgdtfscmvghealplaftqktidrlagkpthvnvsvvm aevdgtcy Human J Chain:
(SEQ ID NO: 505)
agatctcaagaagatgaaaggattgttcttgttgacaacaaatgtaagtgtgcccggattacttccaggatcat ccgttcttccgaagatcctaatgaggacattgtggagagaaacatccgaattattgttcctctgaacaacagggagaatatctctgatc ccacctcaccattgagaaccagatttgtgtaccatttgtctgacctcagctgtaaaaaatgtgatcctacagaagtggagctggataat cagatagttactgctacccagagcaatatctgtgatgaagacagtgctacagagacctgctacacttatgacagaaacaagtgctac acagctgtggtcccactcgtatatggtggtgagaccaaaatggtggaaacagccttaaccccagatgcctgctatcctgactaatcta ga Human J Chain polypeptide
(SEQ ID NO: 506)
rsqederivlvdnkckcaritsriirssedpnediverniriivplnnrenisdptsplrtrfvyhlsdlsckkc dpteveldnqivtatqsnicdedsatctcytydrnkcytavvplvyggctkmvetaltpdacyp HUJCH5nl (J chain 5' primer)
(SEQ ID NO: 507)
gtt gtt aga tct caa gaa gat gaa agg att gtt ctt HUJCH3 (J chain 3' primer-antisense)
(SEQ ID NO: 508)
gtt gtt tct aga tta gtc agg ata gca ggc atc tgg 4 carboxy terminal amino acids deleted from IgA CH3
(SEQ ID NO: 509)
GTCY IgAH IgAT4 Human IgA tail, truncated (3T1)-(missing last 4 amino acids from carboxy terminus)
(SEQ ID NO: 510)
tgatcagccagttccctcaactccacctaccccatctccctcaactccacctacccatctccctcatgctgcc accccgactgtcactgcaccgaccggccctcgaggacctgctcttaggttcagaagcgatcctcacgtgcacactgaccggcct gagagatgcctcaggtgtcaccttcacctggacgccctcaagtgggaagagcgctgttcaaggaccacctgaccgtgacctctgt ggctgctacagcgtgtccagtgtcctgccgggctgtgccgagccatggaaccatgggaagaccttcacttgcactgctgcctaccc -continued cgagtccaagaccccgctaaccgccaccctctcaaaatccggaaacacattccggcccgaggtccacctgctgccgccgccgtc ggaggagctggccctgaacgagctggtgacgctgacgtgcctggcacgtggcttcagccccaaggatgtgctggttcgctggct gcaggggtcacaggagctgccccgcgagaagtacctgacttgggcatcccggcaggagcccagccagggcaccaccaccttc gctgtgaccagcatactgcgcgtggcagccgaggactggaagaaggggggacaccttctcctgcatggtgggccacgaggccct gccgctggccttcccacagaagaccatcgaccgcttggcgggtaaacccacccatgtcaatgtgtctgttgtcatggcggaggtgg actgataatctaga IgAH IgAT4 protein sequence:
(SEQ ID NO: 511)
Dqpvpstpptpspstpptpspscchprlslhrpaledlllgseailtctltglrdasgvtftwtpssgksavqg ppdrdlcgcysvssvlpgcaepwnhgktftctaaypesktpltatlsksgntfrpevhllpppseelalnelvtltelargfspkdvl vrwlqgsqelprekyltwasrqepsqgttttfavtsilrvaaedwkkgdtfscmvghealplaftqktidrlagkpthvnvsvvm aevd HUIGA3T1 (Oligo 3': to delete 4 amino acids at carboxy end of IgA CH3)
(SEQ ID NO: 512)
gtt gtt tct aga tta tca gtc cac ctc cgc cat gac aac aga cac HUIGA3T2: (oligo to delete 14 aa at end of IgA -T4)
(SEQ ID NO: 513)
gtt gtt tct aga tta tca ttt acc cgc caa gcg gtc gat ggt ctt NT
2H7 scFv IgAH IgAT4
(SEQ ID NO: 514)
(2H7 scFv IgA 3T1 construct)--truncates the CH3 domain at the 3'end
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctgagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcagccagttccctcaactccacctaccccatctccctcaactcca cctaccccatctcccctcatgctgccaccccgactgtcactgcaccgaccggccctcgaggacctgctcttaggttcagaagcgat cctcacgtgcacactgaccggcctgagagatgcctcaggtgtcaccttcacctgacgccctcaagtgggaagagcgctgttcaa ggaccacctgaccgtgacctctgtggctgctacagcgtgtccagtgtcctgccgggctgtgccgagccatggaaccatgggaaga ccttcacttgcactgctgcctaccccgagtccaagaccccgctaaccgccaccctctcaaaatccggaaacacattccggcccgag gtccacctgctgccgccgccgtcggaggagctggccctgaacgagctggtgacgctgacgtgcctggcacgtggcttcagcccc aaggatgtgctggttcgctggctgcaggggtcacaggagctgccccgcgagaagtacctgacttgggcatcccggcaggagccc agccagggcaccaccaccttcgctgtgaccagcatactgcgcgtggcagccgaggactggaagaaggggggacaccttctcctg catggtgggccacgaggccctgccgctggccttcacacagaagaccatcgaccgcttggcgggtaaacccacccatgtcaatgt gtctgttgtcatggcggaggtggactgataatctaga AA
2H7 scFv IgAH-T4
(SEQ ID NO: 515)
mdfqvqifsfllisasviiargqivlsqspailsaspgekvtmtcrasssvsymhwyqqkpgsspkpwiy apsnlasgvparfsgsgsgtsysltisrveaedaatyyeqqwsfnpptfgagtklelkdgggsggggsggggssqaylqqsgae -continued lvrpgasvkmsckasgytftsynmhwvkqtprqglewigaiypgngdtsynqkfkgkatltvdksssstaymqlssltsedsa vyfcarvvyysnsywyfdvwgtgttvtvssdqpvpstpptpspstpptpspscchprlslhrpaledlllgseailtctltglrdas gvtftwtpssgksavqgppdrdlcgcysvssvlpgcaepwnhgktftctaaypesktpltatlsksgntfrpevhllpppseelal nelvtltclargfspkdvlvrwlqgsqelprekyltwasrqepsqgttttfavtsilrvaaedwkkgdtfscmvghealplaftqkti drlagkpthvnvsvvmaevd 14 amino acids deleted from IgAH-T4 (so that total of 18 amino acids deleted from wild type IgA CH3)
(SEQ ID NO: 516)
PTHVNVSVVMAEVD IgAH IgA-T 8 (Human IgA Tail truncated, 3T2)
(SEQ ID NO: 517)
Tgatcagccagttccctcaactccacctaccccatctccctcaactccacctaccccatctccctcatgctgcc accccgactgtcactgcaccgaccggccctcgaggacctgctcttaggttcagaagcgatcctcacgtgcacactgaccggcct gagagatgcctcaggtgtcaccttcacctggacgccctcaagtgggaagagcgctgttcaaggaccacctgaccgtgacctctgt ggctgctacagcgtgtccagtgtcctgccgggctgtgccgagccatggaaccatgggaagaccttcacttgcactgctgcctaccc cgagtccaagaccccgctaaccgccaccctctcaaaatccggaaacacattccggcccgaggtccacctgctgccgcgccgtc ggaggagctggccctgaacgagctggtgacgctgacgtgcctggcacgtggcttcagccccaaggatgtgctggttcgctggct gcaggggtcacaggagctgccccgcgagaagtacctgacttgggcatcccggcaggagcccagccagggcaccaccaccttc gctgtgaccagcatactgcgcgtggcagccgaggactggaagaaggggggacaccttctcctgcatggtgggccacgaggccct gccgctggccttcacacagaagaccatcgaccgcttggcgggtaaa IgAH IgA-T18 protein sequence:
(SEQ ID NO: 518)
dqpvpstpptpspstpptpspscchprlslhrpaledlllgseailtcthglrdasgvtftwtpssgksavqg ppdrdlcgcysvssvlpgcacpwnhgktftctaaypesktpltatlsksgntfrpevhllpppseelalnelvtltclargfspkdvl vrwlqgsqelprekyltwasrqepsqgttttfavtsilrvaaedwkkgdtfscmvghealplaftqktidrlagk NT
2H7 scFv IgAH IgAT18: (Human IgA Tail truncated, 3T2.)
(SEQ ID NO: 519)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcagccagttccctcaactccacctaccccatctccctcaactcca cctaccccatctccctcatgctgccacccccgactgtcactgcaccgaccggccctcgaggacctgctcttaggttcagaagcgat cctcacgtgcacactgaccggcctgagagatgcctcaggtgtcaccttcacctggacgccctcaagtgggaagagcgctgttcaa ggaccacctgaccgtgacctctgtggctgctacagcgtgtccagtgtcctgccgggctgtgccgagccatggaaccatgggaaga ccttcacttgcactgctgcctaccccgagtccaagaccccgctaaccgccaccctctcaaaatccggaaacacattccggcccgag gtccacctgctgccgcgccgtcggaggagctggccctgaacgagctggtgacgctgacgtgcctggcacgtggcttcagcccc aaggatgtgctggttcgctggctgcaggggtcacaggagctgccccgcgagaagtacctgacttgggcatcccggcaggagccc agccagggcaccaccaccttcgctgtgaccagcatactgcgcgtggcagccgaggactggaagaaggggggacaccttctcctg catggtgggccacgaggccctgccgctggccttcacacagaagaccatcgaccgcttggcgggtaaa

```
AA:
2H7 scFv IgAH IgAT18:
(SEQ ID NO: 520)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqpvpstpptpspstpptpspscchprlslhrpaledlllgseailtctltglrdas gvtftwtpssgksavqgppdrdlcgcysvssvlpgcaepwnhgktftctaaypesktpltatlsksgntfrpevhllpppseelal nelvtltclargfspkdvlvrwlqgsqelprekyltwasrqepsqgttttfavtsilrvaaedwkkgdtfscmvghealplaftqkti drlagk CTLA-4 IgG WTH WTCH2CH3 (Human-oncoMLP-CTLA4EC-hIgGWT)
(SEQ ID NO: 521)
Nucleotide sequence:
gcaacctacatgatggggaatgagttgaccttcctagatgattccatctgcacgggcacctccagtggaaatc aagtgaacctcactatccaaggactgagggccatggacacgggactctacatctgcaaggtggagctcatgtacccaccgccata ctacctgggcataggcaacggaacccagatttatgtaattgatccagaaccgtgcccagattctgatcaacccaaatcttgtgacaaa actcacacatgcccaccgtgcccagcacctgaactcctggggggaccgtcagtcttcctcttccccccaaaacccaaggacaccct catgatctcccggacccctgaggtcacatgcgtggtggtggacgtgagccacgaagaccctgaggtcaagttcaactggtacgtg gacggcgtggaggtgcataatgccaagacaaagccgcgggaggagcagtacaacagcacgtaccgtgtggtcagcgtcctcac cgtcctgcaccaggactggctgaatggcaaggagtacaagtgcaaggtctccaacaaagcccctcccagcccccatcgagaaaac aatctccaaagccaaagggcagccccgagaaccacaggtgtacaccctgcccccatcccgggatgagctgaccaagaaccagg tcagcctgacctgcctggtcaaaggcttctatcccagcgacatcgccgtggagtgggagagcaatgggcagccggagaacaact acaagaccacgcctcccgtgctggactccgacggctccttcttcctctacagcaagctcaccgtggacaagagcaggtggcagca ggggaacgtcttctcatgctccgtgatgcatgaggctctgcacaaccactacacgcagaagagcctctccctgtctccgggtaaatg a CTLA-4 IgG WTH WTCH2CH3 Protein sequence:
(SEQ ID NO: 522)
mgvlltqrtllslvlallfpsmasmamhvaqavvlassrgiasfvceyaspgkatevrvtvlrqadsqvt evcaatymmgneltflddsictgtssgnqvnltiqglramdtglyickvelmypppyylgigngtqiyvidpepcpdsdqpks cdkthtcppcpapellggpsvflfppkpkdtlmisrtpevtcvvvdvshedpevkfnwyvdgvevhnaktkpreeqynstyr vvsvhlhqdwlngkeykckvsnkalpapiektiskakgqprepqvytlppsrdeltknqvsltclvkgfypsdiavewesn gqpennykttppvldsdgsfflyskltvdksrwqqgnvfscsvmhealhnhytqkslslspgk Human OncoM leader Peptide+CTLA4 EC (BclI)
(SEQ ID NO: 523)
Atgggggtactgctcacacagaggacgctgctcagtctggtccttgcactcctgtttccaagcatggcgagc atggcaatgcacgtggcccagcctgctgtggtactggccagcagccgaggcatcgccagctttgtgtgtgagtatgcatctccagg caaagccactgaggtccgggtgacagtgcttcggcaggctgacagccaggtgactgaagtctgtgcggcaacctacatgatggg gaatgagttgaccttcctagatgattccatctgcacgggcacctccagtggaaatcaagtgaacctcactatccaaggactgagggc catggacacgggactctacatctgcaaggtggagctcatgtacccaccgccatactacctgggcataggcaacggaacccagattt atgtaattgatccagaaccgtgcccagattctgatcaa Human OncoM leader Peptide+CTLA4 EC Peptide sequence:
(SEQ ID NO: 524)
mgvlltqrtllslvlallfpsmasmamhvaqpavvlassrgiasfvceyaspgkatevrvtvlrqadsqvt evcaatymmgneltflddsictgtssgnqvnltiqglramdtglyickvelmypppyylgigngtqiyvidpepcpdsdq Human OncoM leader peptide nucleotide
(SEQ ID NO: 525)
atgggggtactgctcacacagaggacgctgctcagtctggtccttgcactcctgtttccaagcatggcgagc
```

-continued atg

Human OncoM leader peptide sequence
(SEQ ID NO: 526):
Mgvlltqrtllslvlallfpsm

NT
Human CTLA4 EC (no Lp)
(SEQ ID NO: 527)
Gcaatgcacgtggcccagcctgctgtggtactggccagcagccgaggcatcgccagctttgtgtgtgagta tgcatctccaggcaaagccactgaggtccgggtgacagtgcttcggcaggctgacagccaggtgactgaagtctgtgcggcaac ctacatgacggggaatgagttgaccttcctagatgattccatctgcacgggcacctccagtggaaatcaagtgaacctcactatcca aggactgagggccatggacacgggactctacatctgcaaggtggagctcatgtacccaccgccatacctgggcataggcaa cggaacccagatttatgtaattgatccagaaccgtgcccagattct AA
Human CTLA4 EC (no Lp)
(SEQ ID NO: 528)
Amhvaqpavvlassrgiasfvceyaspgkatevrvtvlrqadsqvtevcaatymtgneltflddsictgts sgnqvnltiqglramdtglyickvelmypppyylgigngtqiyvidpepcpds NT
Human CTLA4 IgG MTH (SSS) MTCH2CH3
(SEQ ID NO: 529)
Atgggggtactgctcacacagaggacgctgctcagtctggtccttgcactcctgtttccaagcatggcgagc atggcaatgcacgtggcccagcctgctgtggtactggccagcagccgaggcatcgccagctttgtgtgtgagtatgcatctccagg caaagccactgaggtccgggtgacagtgcttcggcaggctgacagccaggtgactgaagtctgtgcggcaacctacatgatggg gaatgagttgaccttcctagatgattccatctgcacgggcacctccagtggaaatcaagtgaacctcactatccaaggactgagggc catggacacgggactctacatctgcaaggtggagctcatgtacccaccgccatacctgggcataggcaacggaacccagattt atgtaattgatccagaaccgtgcccagattctgatcaacccaaatcttctgacaaaactcacacatccccaccgtccccagcacctga actcctggggggatcgtcagtcttcctcttccccccaaaacccaaggacaccctcatgatctcccggacccctgaggtcacatgcgt ggtggtggacgtgagccacgaagaccctgaggtcaagttcaactggtacgtggacggcgtggaggtgcataatgccaagacaaa gccgcgggaggagcagtacaacagcacgtaccgtgtggtcagcgtcctcaccgtcctgcaccaggactggctgaatggcaagg agtacaagtgcaaggtctccaacaaagcccteccagcccccatcgagaaaacaatctccaaagccaaagggcagccccgagaa ccacaggtgtacaccctgcccccatcccgggatgagctgaccaagaaccaggtcagcctgacctgcctggtcaaaggcttctatc ccagcgacatcgccgtggagtgggagagcaatgggcagccggagaacaactacaagaccacgcctcccgtgctggactccga cggctccttcttcctctacagcaagctcaccgtggacaagagcaggtggcagcaggggaacgtcttctcatgctccgtgatgcatg aggctctgcacaaccactacacgcagaagagcctctccctgtctccgggtaaatga AA
Human CTLA4 IgG MTH (SSS) MTCH2CH3
(SEQ ID NO: 530)
Mgvlltqrtllslvlallfpsmasmamhvaqpavvlassrgiasfvceyaspgkatevrvtvlrqadsqvt evcaatymmgneltflddsictgtssgnqvnltiqglramdtglyickvelmypppyylgigngtqiyvidpepcpdsdqpks sdkthtsppspapellggssvflfppkpkdtlmisrtpevtcvvvdvshedpevkfnwyvdgvevhnaktkpreeqynstyr vvsvltvlhqdwlngkeykckvsnkalpapiektiskakgqprepqvytlppsrdeltknqvsltclvkgfypsdiavewesn gqpennykttppvldsdgsfflysklktvdksrwqqgnvfscsvmhealhnhytqkslslspgk CTLA-4 IgAH IgACH2CH3 (Human-oncoMLP-CTLA4EC-IgA)
(SEQ ID NO: 531)
Nucleotide sequence:
atgggggtactgctcacacagaggacgctgctcagtctggtccttgcactcctgtttccaagcatggcgagc atggcaatgcacgtggcccagcctgctgtggtactggccagcagccgaggcatcgccagctttgtgtgtgagtatgcatctccagg caaagccactgaggtccgggtgacagtgcttcggcaggctgacagccaggtgactgaagtctgtgcggcaacctacatgatggg -continued

```
gaatgagttgaccttcctagatgattccatctgcacgggcacctccagtggaaatcaagtgaacctcactatccaaggactgagggc catggactcgggactctacatctgcaaggtggagctcatgtacccaccgccatactacctgggcataggcaacggaacccagattt atgtaattgatccagaaccgtgcccagattctgatcagccagttccctcaactccacctaccccatctccctcaactccacctaccca tctccctcatgctgccaccccgactgtcactgcaccgaccggccctcgaggacctgctcttaggttcagaagcgatcctcacgtgc acactgaccggcctgagagatgcctcaggtgtcaccttcacctggacgccctcaagtgggaagagcgctgttcaaggaccacctg accgtgacctctgtggctgctacagcgtgtccagtgtcctgccgggctgtgccgagccatggaaccatgggaagaccttcacttgc actgctgcctaccccgagtccaagaccccgctaaccgccaccctctcaaaatcggaaacacattccggcccgaggtccacctgc tgccgccgccgtcggaggagctggccctgaacgagctggtgacgctgacgtgcctggcacgtggcttcagccccaaggatgtgc tggttcgctggctgcaggggtcacaggagctgccccgcgagaagtacctgacttgggcatcccggcaggagcccagccagggc accaccaccttcgctgtgaccagcatactgcgcgtggcagccgaggactggaagaaggggggacaccttctcctgcatggtgggc cacgaggccctgccgctggccttcacacagaagaccatcgaccgcttggcgggtaaacccacccatgtcaatgtgtctgttgtcat ggcggaggtggacggcacctgctactgataatctaga
```

CTLA-4 IgAH IgACH2CH3 Protein sequence
(SEQ ID NO: 532):
mgvlltqrtllslvlallfpsmasmamhvaqpavvlassrgiasfvceyaspgkatevrvtvlrqadsqvt evcaatymmgneltflddsictgtssgnqvnhiqglramdtglyickvelmyppppyylgigngtqiyvidpepcpdsdqpv pstpptpspstpptpspscchprlslhrpaledlllgseailtctltglrdasgvtftwtpssgksavqgppdrdlcgcysvssvlpg caepwnhgktftctaaypesktpltatlsksgntfrpevhllpppseelalnelvtltclargfspkdvlvrwlqgsqelprekylt wasrqepsqgttttfavtsilrvaaedwkkgdtfscmvghealplafiqktidrlagkpthvnvsvvmaevdgtcy CTLA-4 IgAH IgA-T4 (Human-oncoMLP-CTLA4EC-IgA3T1)
(SEQ ID NO: 533)
Nucleotide sequence:

```
atgggggtactgctcacacagaggacgctgctcagtctggtccttgcactcctgtttccaagcatggcgagc atggcaatgcacgtggcccagcctgctgtggtactggccagcagccgaggcatcgccagctttgtgtgtgagtatgcatctccagg caaagccactgaggtccgggtgacagtgcttcggcaggctgacagccaggtgactgaagtctgtgcggcaacctacatgatggg gaatgagttgaccttcctagatgattccatctgcacgggcacctccagtggaaatcaagtgaacctcactatccaaggactgagggc catggacacgggactctacatctgcaaggtggagctcatgtacccaccgccatactacctgggcataggcaacggaacccagattt atgtaattgatccagaaccgtgcccagattctgatcagccagttccctcaactccacctaccccatctccctcaactccacctaccca tctccctcatgctgccaccccgactgtcactgcaccgaccggccctcgaggacctgctcttaggttcagaagcgatcctcacgtgc acactgaccggcctgagagatgcctcaggtgtcaccttcacctggacgccctcaagtgggaagagcgctgttcaaggaccacctg accgtgacctctgtggctgctacagcgtgtccagtgtcctgccgggctgtgccgagccatggaaccatgggaagaccttcacttgc actgctgcctaccccgagtccaagaccccgctaaccgccaccctctcaaaatcggaaacacattccggcccgaggtccacctgc tgccgccgcgtcggaggagctggccctgaacgagctggtgacgctgacgtgcctggcacgtggcttcagccccaaggatgtgc tggttcgctggctgcaggggtcacaggagctgccccgcgagaagtacctgacttgggcatcccggcaggagcccagccagggc accaccaccttcgctgtgaccagcatactgcgcgtggcagccgaggactggaagaaggggggacaccttctcctgcatggtgggc cacgaggccctgccgctggccttcacacagaagaccatcgaccgcttggcgggtaaacccacccatgtcaatgtgtctgttgtcat ggcggaggtggactgataatctaga
```

CTLA-4 IgAH IgA-T4 Protein sequence
(SEQ ID NO: 534):
Mgvlltqrtllslvlallfpsmasmanthvaqpavvlassrgiasfvceyaspgkatevrvtvlrqadsqvt evcaatymmgneltflddsictgtssgnqvnltiqglramdtglyickvelmyppppyylgigngtqiyvidpepcpdsdqpv pstpptpspstpptpspscchprlslhrpaledlllgseailtctltglrdasgvtftwtpssgksavqgppdrdlcgcysvssvlpg caepwnhgktftctaaypesktpltatlsksgntfrpevhllpppseelalnelvtltclargfspkdvlvrwlqgsqelprekylt wasrqepsqgttttfavtsilrvaaedwkkgdtfscmvghealplaftqktidrlagkpthvnvsvvmaevd

```
NT
human IgG1 CH2 with 238 mutation pro→ser
(SEQ ID NO: 535)
cctgaactcctggggggatcgtcagtcttcctcttccccccaaaacccaaggacaccctcatgatctcccgga cccctgaggtcacatgcgtggtggtggacgtgagccacgaagaccctgaggtcaagttcaactggtacgtggacggcgtggag tgcataatgccaagacaaagccgcggggaggagcagtacaacagcacgtaccgtgtggtcagcgtcctcaccgtcctgcaccagg actggctgaatggcaaggagtacaagtgcaaggtctccaacaaagcccteccagcccccatcgagaaaaccatctccaaagcca aag AA
human IgG1 CH2 with 238 mutation pro-→ser
(SEQ ID NO: 536)
pellggssvflfppkpkdtlmisrtpevtcvvvdvshedpevkfnwyvdgvevhnaktkpreeqynst yrvvsvltvlhqdwlngkeykckvsnkalpapiektiskak Amino acids surrounding Pro to Ser in CH2
(SEQ ID NO: 537)
PAPELLGGPS Amino acids surrounding Pro to Ser in CH2
(SEQ ID NO: 538)
PAPELLGGSS HIgE5Bcl
(SEQ ID NO: 539)
gtt gtt gat cac gtc tgc tcc agg gac ttc acc cc hIgE3 stop
(SEQ ID NO: 540)
gtt gtt tct aga tta act ttt acc ggg att tac aga cac cgc tcg ctg g hIgE3BB (leaves an open reading frame at end of gene to read into
transmembrane and cytoplasmic tail domain attached at either the BamHI or SfuI sites)
(SEQ ID NO: 541)
gtt gtt ttc gaa gga tcc gct tta ccg gga ttt aca gac acc gct cgc tgg NT
human IgE Fc (CH2-CH3-CH4) ORF
(SEQ ID NO: 542):
tgatcacgtctgctccagggacttcaccccgcccaccgtgaagatcttacagtcgtcctgcgacggcggcg ggcacttccccccgaccatccagctcctgtgcctcgtctctgggtacacccagggactatcaacatcacctggctggaggacgg gcaggtcatggacgtggacttgtccaccgcctctaccacgcaggagggtgagctggcctccacacaaagcgagctcaccctcag ccagaagcactggctgtcagaccgcacctacacctgccaggtcacctatcaaggtcacacctttgaggacagcaccaagaagtgt gcagattccaacccgagaggggtgagcgcctacctaagccggcccagcccgttcgacctgttcatccgcaagtcgcccacgatc acctgtctggtggtggacctggcacccagcaaggggaccgtgaacctgacctggtcccgggccagtgggaagcctgtgaacca ctccaccagaaaggaggagaagcagcgcaatggcacgttaaccgtcacgtccacccctgccggtgggcacccgagactggatcg agggggagacctaccagtgcagggtgaccccaccccacctgcccagggccctcatgcggtccacgaccaagaccagcggccc gcgtgctgccccggaagtctatgcgtttgcgacgccggagtggccggggagccgggacaagcgcaccctcgcctgcctgatcc agaacttcatgcctgaggacatctcggtgcagtggctgcacaacgaggtgcagctcccggacgcccggcacagcacgacgcag ccccgcaagaccaagggctccggcttcttcgtcttcagccgcctggaggtgaccagggccgaatgggagcagaaagatgagttc atctgccgtgcagtccatgaggcagcgagcccctcacagaccgtccagcgagcggtgtctgtaaatcccggtaaagcggatcctt cgaa AA
human IgE Fc (CH2-CH3-CH4) ORF
(SEQ ID NO: 543):
dhvcsrdftpptvkilqsscdgghhfpptiqllclvsgytpgtinitwledgqvmdvdlstasttqegelast qseltlsqkhwlsdrtyteqvtyqghtfedstkkcadsnprgvsaylsrpspfdlfirksptitelvvdlapskgtvnltwsrasgk pvnhstrkeekqrngtltvtstlpvgtrdwiegetyqcrvthphlpralmrsttktsgpraapevyafatpewpgsrdkrtlacliq
```

-continued nfmpedisvqwlhnevqlpdarhsttqprktkgsgffvfsrlevtraeweqkdeficravheaaspsqtvqravsvflpgkadp s IFhIgGwtBcl5
(SEQ ID NO: 544)
gtt gtt tga tca gga gcc caa atc ttg tga caa aac tca cac atg ccc acc gtg ccc agc acc (63 mer)

hIgGWT3xba
(SEQ ID NO: 545)
gtt gtt tct aga tca ttt acc cgg aga cag gga gag gct ctt ctg cgt gta g HuIgGMHWC (sense, 5' primer for mutating wild type hinge CCC to mutant SSS
(SEQ ID NO: 546)
gtt gtt gat cag gag ccc aaa tct tct gac aaa act cac aca tct cca ccg tcc cca gca cct gaa ctc ctg ggt gga ccg tca gtc ttc c NT
1D8 VH
(SEQ ID NO: 547)
caggtgcagctgaaggaggcaggacctggcctggtgcaaccgacacagaccctgtccctcacatgcactg tctctgggttctcattaaccagcgatggtgtacactggattcgacagcctccaggaaagggtctggaatggatgggaataatatattat gatggaggcacagattataattcagcaattaaatccagactgagcatcagcagggacacctccaagagccaagttttcttaaaaatc aacagtctgcaaactgatgacacagccatgtattactgtgccagaatccactttgattactggggccaaggagtcatggtcacagtct cctct AA
1D8 VH (no leader)
(SEQ ID NO: 548)
qvqlkeagpglvqptqtlsltctvsgfsltsdgvhwirqppgkglewmgiiyydggtdynsaiksrlsisr dtsksqvflkinslqtddtamyycarihfdywgqgvmvtvss NT
1D8 VL (no leader)
(SEQ ID NO: 549)
gacattgtgctcactcagtctccaacaaccatagctgcatctccaggggagaaggtcaccatcacctgccgt gccagctccagtgtaagttacatgtactggtaccagcagaagtcaggcgcctcccctaaactctggatttatgacacatccaagctg gcttctggagttccaaatcgcttcagtggcagtgggtctgggacctcttattctctcgcaatcaacaccatggagactgaagatgctg ccacttattactgtcagcagtggagtagtactccgctcacgttcgggtctgggaccaagctggagatcaaacgg AA
1D8 VL
(SEQ ID NO: 550)
divltqspttiaaspgekvtitcrasssvsymywyqqksgaspklwiydtsklasgvpnrfsgsgsgtsys laintmetedaatyycqqwsstpltfgsgtkleikr NT
1D8 scFv
(SEQ ID NO: 551)
aagcttatggattttcaagtgcagattttcagcttcctgctaatcagtgcttcagtcataatgtccagaggagtcg acattgtgctcactcagtctccaacaaccatagctgcatctccaggggagaaggtcaccatcacctgccgtgccagctccagtgtaa gttacatgtactggtaccagcagaagtcaggcgcctcccctaaactctggatttatgacacatccaagctggcttctggagttccaaa tcgcttcagtggcagtgggtctgggacctcttattctctcgcaatcaacaccatggagactgaagatgctgccacttattactgtcagc agtggagtagtactccgctcacgttcgggtctgggaccaagctggagatcaaacggggtggcggtggctcggcggtggtgggt cgggtggcggcggatctcaggtgcagctgaaggaggcaggacctggcctggtgcaaccgacacagaccctgtccctcacatgc actgtctctgggttctcattaaccagcgatggtgtacactggattcgacagcctccaggaaagggtctggaatggatgggaataatat attatgatggaggcacagattataattcagcaattaaatccagactgagcatcagcagggacacctccaagagccaagttttcttaaa aatcaacagtctgcaaactgatgacacagccatgtattactgtgccagaatccactttgattactggggccaaggagtcatggtcaca gtctcctctgatca AA
1D8 scFv
(SEQ ID NO: 552)
mdfqvqifsfllisasvimsrgvdivltqspttiaaspgekvtitcrasssvsymywyqqksgaspklwiy dtsklasgvpnrfsgsgsgtsyslaintmetedaatyycqqwsstpltfgsgtkleikrggggsggggsggggsqvqlkeagpg lvqptqtlsltctvsgfsltsdgvhwirqppgkglewmgiiyydggtdynsaiksrlsisrdtsksqvflkinslqtddtamyyca rihfdywgqgvmvtvss NT
1D8 scFv IgG WTH WTCH2CH3
(SEQ ID NO: 553)
aagcttatggattttcaagtgcagattttcagcttcctgctaatcagtgcttcagtcataatgtccagaggagtcg acattgtgctcactcagtctccaacaaccatagctgcatctccaggggagaaggtcaccatcacctgccgtgccagctccagtgtaa gttacatgtactggtaccagcagaagtcaggcgcctcccctaaactctggatttatgacacatccaagctggcttctggagttccaaa tcgcttcagtggcagtgggtctgggacctcttattctctcgcaatcaacaccatggagactgaagatgctgccacttattactgtcagc agtggagtagtactccgctcacgttcgggtctgggaccaagctggagatcaaacggggtggcggtggctcggcggtggtgggt cgggtggcggcggatctcaggtgcagctgaaggaggcaggacctggcctggtgcaaccgacacagaccctgtccctcacatgc actgtctctggttctcattaaccagcgatggtgtacactggattcgacagcctccaggaaaggtctggaatggatgggaataatat attatgatggaggcacagattataattcagcaattaaatccagactgagcatcagcagggacacctccaagagccaagttttcttaaa aatcaacagtctgcaaactgatgacacagccatgtattactgtgccagaatccactttgattactggggccaaggagtcatggtcaca gtctcctctgatcaggagcccaaatcttgtgacaaaactcacacatgcccaccgtgcccagcacctgaactcctggggggaccgtc agtcttcctcttccccccaaaacccaaggacaccctcatgatctcccggacccctgaggtcacatgcgtggtggtggacgtgagcc acgaagaccctgaggtcaagttcaactggtacgtggacggcgtggaggtgcataatgccaagacaaagccgcgggaggagcag tacaacagcacgtaccgtgtggtcagcgtcctcaccgtcctgcaccaggactggctgaatggcaaggagtacaagtgcaaggtct ccaacaaagccctcccagcccccatcgagaaaacaatctccaaagccaaagggcagccccgagaaccacaggtgtacaccctg cccccatcccgggatgagctgaccaagaaccaggtcagcctgacctgcctggtcaaaggcttctatcccagcgacatcgccgtgg agtgggagagcaatgggcagccggagaacaactacaagaccacgcctcccgtgctggactccgacggctccttcttcctctacag caagctcaccgtggacaagagcaggtggcagcaggggaacgtcttctcatgctccgtgatgcatgaggctctgcacaaccactac acgcagaagagcctctccctgtctccgggtaaatgatctaga AA
1D8 scFv IgG WTH WTCH2CH3
(SEQ ID NO: 554)
mdfqvqifsfllisasvimsrgvdivltqspttiaaspgekvtitcrasssvsymywyqqksgaspklwiy dtsklasgvpnrfsgsgsgtsyslaintmetedaatyycqqwsstpltfgsgtkleikrggggsggggsggggsqvqlkeagpg lvqptqtlsltctvsgfsltsdgvhwirqppgkglewmgiiyydggtdynsaiksrlsisrdtsksqvflkinslqtddtamyyca rihfdywgqgvmvtvssdqepkscdkthtcppcpapellggpsvflfppkpkdtlmisrtpevtcvvvdvshedpevkfnw yvdgvevhnaktkpreeqynstyrvvsvltvlhqdwlngkeykckvsnkalpapiektiskakgqprepqvytlppsrdeltk nqvsltclvkgfypsdiavewesngqpennykttppvldsdgsfflysklkvdksrwqqgnvfscsvmhealhnhytqkslsl spgk NT
1D8 scFv IgG MTH MTCH2CH3-CD80
(SEQ ID NO: 555)
aagcttatggattttcaagtgcagattttcagcttcctgctaatcagtgcttcagtcataatgtccagaggagtcg acattgtgctcactcagtctccaacaaccatagctgcatctccaggggagaaggtcaccatcacctgccgtgccagctccagtgtaa gttacatgtactggtaccagcagaagtcaggcgcctcccctaaactctggatttatgacacatccaagctggcttctggagttccaaa tcgcttcagtggcagtgggtctgggacctcttattctctcgcaatcaacaccatggagactgaagatgctgccacttattactgtcagc agtggagtagtactccgctcacgttcgggtctgggaccaagctggagatcaaacggggtggcggtggctcggcggtggtgggt -continued cgggtggcggcggatctcaggtgcagctgaaggaggcaggacctggcctggtgcaaccgacacagaccctgtccctcacatgc actgtctctgggttctcattaaccagcgatggtgtacactggattcgacagcctccaggaaagggtctggaatggatgggaataatat attatgatggaggcacagattataattcagcaattaaatccagactgagcatcagcagggacacctccaagagccaagttttcttaaa aatcaacagtctgcaaactgatgacacagccatgtattactgtgccagaatccactttgattactggggccaaggagtcatggtcaca gtctcctctgatctggagcccaaatcttctgacaaaactcacacaagcccaccgagcccagcacctgaactcctgggggatcgtc agtcttcctcttcccccaaaacccaaggacaccctcatgatctcccggacccctgaggtcacatgcgtggtggtggacgtgagcc acgaagaccctgaggtcaagttcaactggtacgtggacggcgtggaggtgcataatgccaagacaaagccgcgggaggagcag tacaacagcacgtaccgtgtggtcagcgtcctcaccgtcctgcaccaggactggctgaatggcaaggagtacaagtgcaaggtct ccaacaaagccctcccagcccccatcgagaaaaccatctccaaagccaaagggcagccccgagaaccacaggtgtacaccctg cccccatcccgggatgagctgaccaagaaccaggtcagcctgacctgcctggtcaaaggcttctatcccagcgacatcgccgtgg agtgggagagcaatgggcagccggagaacaactacaagaccacgcctcccgtgctggactccgacggctccttcttcctctacag caagctcaccgtggacaagagcaggtggcagcaggggaacgtcttctcatgctccgtgatgcatgaggctctgcacaaccactac acgcagaagagcctctccctgtctccgggtaaagcggatccttcgaacctgctcccatcctgggccattaccttaatctcagtaaatg gaattttttgtgatatgctgcctgacctactgctttgccccaagatgcagagagagaaggaggaatgagagattgagaagggaaagt gtacgccctgtataaatcgata AA
1D8 scFv IgG MTH MTCH2CH3-CD80
(SEQ ID NO: 556)
mdfqvqifsfllisasvimsrgvdivltqspttiaaspgekvtitcrassssvsymywyqqksgaspklwiy dtsklasgvpnrfsgsgsgtsyslaintmetedaatyycqqwsstpltfgsgtkleikrggggsggggsggggsqvqlkeagpg lvqptqtlsltctvsgfsltsdgvhwirqppgkglewmgiiyydggtdynsaiksrlsisrdtsksqvflkinslqtddtamyyca rihfdywgqgvmvtvssdlepkssdkthtsppspapellggssvflfbpkpkdtlmisrtpevtcvvvdvshedpevkfnwy vdgvevhnaktkpreeqynstyrvvsvltvlhqdwlngkeykckvsnkalpapiektiskakgqprepqvytlppsrdeltkn qvsltclvkgfypsdiavewesngqpennykttppvldsdgsfflyskltvdksrwqqgnvfscsvmhealhnhytqkslsls pgkadpsnllpswaitlisvngifvicclttycfaprcrerrrnerlrresvrpv NT
1D8 scFv IgG WTH WTCH2CH3-CD80
(SEQ ID NO: 557)
aagcttatggattttcaagtgcagattttcagcttcctgctaatcagtgcttcagtcataatgtccagaggagtcg acattgtgctcactcagtctccaacaaccatagctgcatctccaggggagaaggtcaccatcacctgccgtgccagctccagtgtaa gttacatgtactggtaccagcagaagtcaggcgcctcccctaaactctggatttatgacacatccaagctggcttctggagttccaaa tcgcttcagtggcagtgggtctgggacctcttattctctcgcaatcaacaccatggagactgaagatgctgccacttattactgtcagc agtggagtagtactccgctcacgttcgggtctgggaccaagctggagatcaaacggggtggcggtggctcggcggtggtgggt cgggtggcggcggatctcaggtgcagctgaaggaggcaggacctggcctggtgcaaccgacacagaccctgtccctcacatgc actgtctctgggttctcattaaccagcgatggtgtacactggattcgacagcctccaggaaagggtctggaatggatgggaataatat attatgatggaggcacagattataattcagcaattaaatccagactgagcatcagcagggacacctccaagagccaagttttcttaaa aatcaacagtctgcaaactgatgacacagccatgtattactgtgccagaatccactttgattactggggccaaggagtcatggtcaca gtctcctctgatctggagcccaaatcttgtgacaaaactcacacatgcccaccgtgcccagcacctgaactcctgggggaccgtc agtcttcctcttcccccaaaacccaaggacaccctcatgatctcccggacccctgaggtcacatgcgtggtggtggactgagcc acgaagaccctgaggtcaagttcaactggtacgtggacggcgtggaggtgcataatgccaagacaaagccgcgggaggagcag tacaacagcacgtaccgtgtggtcagcgtcctcaccgtcctgcaccaggactggctgaatggcaaggagtacaagtgcaaggtct ccaacaaagccctcccagcccccatcgagaaaaccatctccaaagccaaagggcagccccgagaaccacaggtgtacaccctg cccccatcccgggatgagctgaccaagaaccaggtcagcctgacctgcctggtcaaaggcttctatcccagcgacatcgccgtgg agtgggagagcaatgggcagccggagaacaactacaagaccacgcctcccgtgctggactccgacggctccttcttcctctacag caagctcaccgtggacaagagcaggtggcagcaggggaacgtcttctcatgctccgtgatgcatgaggctctgcacaaccactac acgcagaagagcctctccctgtctccgggtaaagcggatccttcgaacctgctcccatcctgggccattaccttaatctcagtaaatg gaattttgtgatatgctgcctgacctactgctttgccccaagatgcagagagagaaggaggaatgagagattgagaagggaaagt gtacgccctgtataaatcgata AA
1D8 scFv IgG WTH WTCH2CH3-CD80
(SEQ ID NO: 558)
mdfqvqifsfllisasvimsrgvdivltqspttiaaspgekvtitcrasssvsymywyqqksgaspklwiy dtsklasgvpnrfsgsgsgtsyslaintmetedaatyycqqwsstpltfgsgtkleiklggggsggggsggggsqvqlkeagpg lvqptqtlsltctvsgfsltsdgvhwirqppgkglewmgiiyydggtdynsaiksrlsisrdtsksqvflkinslqtddtamyyca rihfdywgqgvmvtvssdlepkscdkthtcppcpapellggpsvflfppkpkdtlmisrtpevtcvvdvshedpevkfnw yvdgvevhnaktkpreeqynstyrvvsvltvlhqdwlngkeykckvsnkalpapiektiskakgqprepqvytlppsrdeltk nqvsltclvkgfypsdiavewesngqpennykttppvldsdgsfflysklktvdksrwqqgnvfscsvmhealhnhytqkslsl spgkadpsnllpswaitlisvngifviccltycfaprcrerrrnerlrresvrpv NT
Anti human CD3 scFv WTH WTCH2CH3
(SEQ ID NO: 559)
aagcttatggattttcaagtgcagattttcagcttcctgctaatcagtgcttcagtcataatgtccagaggagtcg acatccagatgacacagactacatcctcccctgtctgcctctctgggagacagagtcaccatcagttgcagggcaagtcaggacattc gcaattatttaaactggtatcagcagaaaccagatggaactgttaaactcctgatctactacacatcaagattacactcaggagtccca tcaaggttcagtggcagtgggtctggaacagattattctctcaccattgccaacctgcaaccagaagatattgccacttacttttgcca acagggtaatacgcttccgtggacgttcggtggaggcaccaaactggtaaccaaacgggagctcggtggcggtggctcgggcg gtggtgggtcgggtggcggcggatctatcgatgaggtccagctgcaacagtctggacctgaactggtgaagcctggagcttcaat gtcctgcaaggcctctggttactcattcactggctacatcgtgaactggctgaagcagagccatggaaagaaccttgagtggattgg acttattaatccatacaaaggtcttactacctacaaccagaaattcaagggcaaggccacattaactgtagacaagtcatccagcaca gcctacatggagctcctcagtctgacatctgaagactctgcagtctattactgtgcaagatctgggtactatggtgactcggactggta cttcgatgtctggggcgcagggaccacggtcaccgtctcctctgatcaggagcccaaatcttgtgacaaaactcacacatgcccac cgtgcccagcacctgaactcctggggggaccgtcagtcttcctcttccccccaaaacccaaggacaccctcatgatctcccggacc cctgaggtcacatgcgtggtggtggacgtgagccacgaagaccctgaggtcaagttcaactggtacgtggacggcgtggaggtg cataatgccaagacaaagccgcgggaggagcagtacaacagcacgtaccgtgtggtcagcgtcctcaccgtcctgcaccagga ctggctgaatggcaaggagtacaagtgcaaggtctccaacaaagcccccagccccatcgagaaaacaatctccaaagccaa agggcagccccgagaaccacaggtgtacaccctgcccccatcccgggatgagctgaccaagaaccaggtcagcctgacctgcc tggtcaaaggcttctatcccagcgacatcgccgtggagtgggagagcaatgggcagccggagaacaactacaagaccacgcctc ccgtgctggactccgacggctccttcttcctctacagcaagctcaccgtggacaagagcaggtggcagcaggggaacgtcttctca tgctccgtgatgcatgaggctctgcacaaccactacacgcagaagagcctctccctgtctccgggtaaatgatctaga AA
Anti human CD3 scFv WTH WTCH2CH3
(SEQ ID NO: 560)
Mdfqvqifsfllisasvimsrgvdiqmtqttsslsaslgdrvtiscrasqdirnlylnwyqqkpdgtvklliy ytsrlhsgvpsrfsgsgsgtdysltianlqpediatyfcqqgntlpwtfgggtklvtkrelggggsggggsggggsidevqlqqsg pelvkpgasmsckasgysftgyivnwlkqshgknlewiglinpykglttynqkflgkatltvdkssstaymellsltsedsavy ycarsgyygdsdwyfdvwgagttvtvssdqepkscdkthtcppcpapellggpsvflfppkpkdtlmisrtpevtcvvvdvs hedpevkfnwyvdgvevhnaktkpreeqynstyrvvsvltvlhqdwlngkeykckvsnkalpapiektiskakgqprepq -continued vytlppsrdeltknqvsltclvkgfypsdiavewesngqpennykttppvldsdgsfflyskltvdkslwqqgnvfscsvmhe alhnhytqkslslspgk NT
2H7-antiCD40 scFv MTH (SSS) MTCH2WTCH3
(SEQ ID NO: 561)
2h7-40.2.220Ig+restriction sites
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgcccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaaggtggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaatccaactctgaagaagcaaagaaagaggaggccaaaag gaggaagccaagaaatctaacagcgtcgacattgttctgactcagtctccagccaccctgtctgtgactccaggagatagagtctct ctttcctgcagggccagccagagtattagcgactacttacactggtatcaacaaaaatcacatgagtctccaaggcttctcatcaaata tgcttcccattccatctctgggatccctccaggttcagtggcagtggatcagggtcagatttcactctcagtatcaacagtgtggaac ctgaagatgttggaatttattactgtcaacatggtcacagctttccgtggacgttcggtggaggcaccaagctggaaatcaaacggg gtggcggtggctcgggcggaggtgggtcggtggcggcggatctcagatccagttggtgcaatctggacctgagctgaagaag cctggagagacagtcaggatctcctgcaaggcttctgggtatgccttcacaactactggaatgcagtgggtgcaagagatgccagg aaaggggtttgaagtggattggctggataaacacccccactctggagtgccaaaatatgtgaagacttcaaggacggtttgccttctct ttggaaacctctgccaacactgcatatttacagataagcaacctcaaagatgaggacacggctacgtatttctgtgagatccggga atggtaactatgacctggcctactttgcttactggggccaagggacactggtcactgtctctgatcaggagcccaaatcttctgacaa aactcacacatccccaccgtccccagcacctgaactcctggggggatcgtcagtcttcctcttccccccaaaacccaaggacaccc tcatgatctcccggacccctgaggtcacatgcgtggtggtggacgtgagccacgaagaccctgaggtcaagttcaactggtacgtg gacggcgtggaggtgcataatgccaagacaaagccgcgggaggagcagtacaacagcacgtaccgtgtggtcagcgtcctcac cgtcctgcaccaggactggctgaatggcaaggagtacaagtgcaaggtctccaacaaagccctcccagcccccatcgagaaaac aatctccaaagccaaagggcagccccgagaaccacaggtgtacaccctgcccccatcccgggatgagctgaccaagaaccagg tcagcctgacctgcctggtcaaaggcttctatcccagcgacatcgccgtggagtgggagagcaatgggcagccggagaacaact acaagaccacgcctcccgtgctggactccgacggctccttcttcctctacagcaagctcaccgtggacaagagcaggtggcagca ggggaacgtcttctcatgctccgtgatgcatgaggctctgcacaaccactacacgcagaagagcctctccctgtctccgggtaaatg atctaga AA
2H7-antiCD40 scFv MTH (SSS) MTCH2WTCH3
(SEQ ID NO: 562)
2H7-40.2.220Ig
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkggggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqsnseeakkeeakkeeakksnsvdivltqspatlsvtpgdrvslscrasqsis dylhwyqqkshesprllikyashsisgipsrfsgsgsgsdftlsinsvepedvgiyycqhghsfpwtfgggtkleikrggggsg gggsggggsqiqlvqsgpelkkpgetvrisckasgyaftttgmqwvqempgkglkwigwintplwsakicrrlqgrfafslet -continued santaylqisnlkdedtatyfcvrsgngnydlayfaywgqgtlvtvsdqepkssdkthtsppspapellggssvflfppkpkdtl misrtpevtcvvvdvshedpevkfnwyvdgvevhnaktkpreeqynstyrvvsvltvlhqdwlngkeykckvsnkalpap iektiskakgqprepqvytlppsrdeltknqvsltclvkgfypsdiavewesngqpennykttppvldsdgsfflyskltvdksr wqqgnvfscsvmhealhnhytqkslslspgk NT
5B9 VH (includes the VH leader peptide)
(SEQ ID NO: 563)
atggctgtcttggggctgctcttctgcctggtgacatttccaagctgtgtcctatcccaggtgcagctgaagca gtcaggacctggcctagtgcagtcctcacagagcctgtccatcacctgcacagtctctggtttctcattaactacctatgctgtacact gggttcgccagtctccaggaaagggtctggagtggctgggagtgatatggagtggtggaatcacagactataatgcagctttcatat ccagactgagcatcaccaaggacgattccaagagccaagttttctttaaaatgaacagtctgcaacctaatgacacagccatttatta ctgtgccagaaatgggggtgataactaccctattactatgctatggactactggggtcaaggaacctcagtcaccgtctcctca 5B9 VH missing the leader
(SEQ ID NO: 564):
caggtgcagctgaagcagtcaggacctggcctagtgcagtcctcacagagcctgtccatcacctgcacagt ctctggtttctcattaactacctatgctgtacactgggttcgccagtctccaggaaagggtctggagtggctgggagtgatatggagt ggtggaatcacagactataatgcagctttcatatccagactgagcatcaccaaggacgattccaagagccaagttttctttaaaatga acagtctgcaacctaatgacacagccatttattactgtgccagaaatgggggtgataactaccctattactatgctatggactactgg ggtcaaggaacctcagtcaccgtctcctca AA
5B9 VH (includes leader peptide)
(SEQ ID NO: 565)
MAVLGLLFCLVTFPSCVLSQVQLKQSGPGLVQSSQSLSITCTVSGFSL

TTYAVHWVRQSPGKGLEWLGVIWSGGITDYNAAFISRLSITKDDSKSQVFFKMNS

LQPNDTAIYYCARNGGDNYPYYYAMDYWGQGTSVTVSS

5B9 VH no leader peptide
(SEQ ID NO: 566)
QVQLKQSGPGLVQSSQSLSITCTVSGFSLTTYAVHWVRQSPGKGLE

WLGVIWSGGITDYNAAFISRLSLTKDDSKSQVFFKMNSLQPNDTAIYYCARNGGDN

YPYYYAMDYWGQGTSVTVSS

NT
5B9 VL
(SEQ ID NO: 567)
atgaggttctctgctcagcttctggggctgcttgtgctctggatccctggatccactgcagatattgtgatgacg caggctgcattctccaatccagtcactcttggaacatcagcttccatctcctgcaggtctagtaagagtctcctacatagtaatggcatc acttatttgtattggtatctgcagaagccaggccagtctcctcagctcctgatttatcagatgtccaaccttgcctcaggagtcccagac aggttcagtagcagtgggtcaggaactgatttcacactgagaatcagcagagtggaggctgaggatgtgggtgtttattact~gct caaaatctagaacttccgctcacgttcggtgctgggaccaagctggagctgaaacgg

AA
5B9 VL
(SEQ ID NO: 568)
MRFSAQLLGLLVLWIPGSTADIVMTQAAFSNPVTLGTSASISCRSSKS

LLHSNGITYLYWYLQKPGQSPQLLIYQMSNLASGVPDRFSSSGSGTDFTLRISRVEA

EDVGVYYCAQNLELPLTFGAGTKLELKR

NT
5B9 scFv
(SEQ ID NO: 569)
aagcttgccgccatgaggttctctgctcagcttctggggctgcttgtgctctggatccctggatccactgcaga tattgtgatgacgcaggctgcattctccaatccagtcactcttggaacatcagcttccatctcctgcaggtctagtaagagtctcctaca tagtaatggcatcacttatttgtattggtatctgcagaagccaggccagtctcctcagctcctgatttatcagatgtccaaccttgcctca -continued ggagtcccagacaggttcagtagcagtgggtcaggaactgatttcacactgagaatcagcagagtggaggctgaggatgtgggtg tttattactgtgctcaaaatctagaacttccgctcacgttcggtgctgggaccaagctggagctgaaacggggtggcggtggctcgg gcggtggtgggtcgggtggcggcggatcgtcacaggtgcagctgaagcagtcaggacctggcctagtgcagtcctcacagagc ctgtccatcacctgcacagtctctggtttctcattaactacctatgctgtacactgggttcgccagtctccaggaaagggtctggagtg gctgggagtgatatggagtggtggaatcacagactataatgcagctttcatatccagactgagcatcaccaaggacgattccaaga gccaagttttctttaaaatgaacagtctgcaacctaatgacacagccatttattactgtgccagaaatgggggtgataactacccttatt actatgctatggactactggggtcaaggaacctcagtcaccgtctcctct AA
5B9 scFv
(SEQ ID NO: 570)
MRFSAQLLGLLVLWIPGSTADIVMTQAAFSNPVTLGTSASISCRSSKS

LLHSNGITYLYWYLQKPGQSPQLLIYQMSNLASGVPDRFSSGSGTDFTLRISRVEA

EDVGVYYCAQNLELPLTFGAGTKLELKRGGGGSGGGGSGGGGSSQVQLKQSGPG

LVQSSQSLSITCTVSGFSLTTYAVHWVRQSPGKGLEWLGVIWSGGITDYNAAFISR

LSITKDDSKSQVFFKMNSLQPNDTAIYYCARNGGDNYPYYYAMDYWGQGTSVTV

SS

NT
5B9 scFv-hmtIgG1-hCD80
(SEQ ID NO: 571)
aagcttgccgccatgaggttctctgctcagcttctggggctgcttgtgctctggatccctggatccactgcaga tattgtgatgacgcaggctgcattctccaatccagtcactcttggaacatcagcttccatctcctgcaggtctagtaagagtctcctaca tagtaatggcatcacttatttgtattggtatctgcagaagccaggccagtctcctcagctcctgatttatcagatgtccaaccttgcctca ggagtcccagacaggttcagtagcagtgggtcaggaactgatttcacactgagaatcagcagagtggaggctgaggatgtgggtg tttattactgtgctcaaaatctagaacttccgctcacgttcggtgctgggaccaagctggagctgaaacggggtggcggtggctcgg gcggtggtgggtcgggtggcggcggatcgtcacaggtgcagctgaagcagtcaggacctggcctagtgcagtcctcacagagc ctgtccatcacctgcacagtctctggtttctcattaactacctatgctgtacactgggttcgccagtctccaggaaagggtctggagtg gctgggagtgatatggagtggtggaatcacagactataatgcagctttcatatccagactgagcatcaccaaggacgattccaaga gccaagttttctttaaaatgaacagtctgcaacctaatgacacagccatttattactgtgccagaaatgggggtgataactacccttatt actatgctatggactactggggtcaaggaacctcagtcaccgtctcctctgatctggagcccaaatcttctgacaaaactcacacaag cccaccgagcccagcacctgaactcctggggggatcgtcagtcttcctcttccccccaaaacccaaggacaccctcatgatctccc ggacccctgaggtcacatgcgtggtggtggacgtgagccacgaagaccctgaggtcaagttcaactggtacgtggacggcgtgg aggtgcataatgccaagacaaagccgcgggaggagcagtacaacagcacgtaccgtgtggtcagcgtcctcaccgtcctgcacc aggactggctgaatggcaaggagtacaagtgcaaggtctccaacaaagcccteccagccecccatcgagaaaaccatctccaaag ccaaagggcagccecgagaaccacaggtgtacaccctgccccecatcecgggatgagctgaccaagaaccaggtcagcctgacc tgcctggtcaaaggcttctatcccagcgacatcgccgtggagtgggagagcaatgggcagccggagaacaactacaagaccac gcctcccgtgctggactccgacggctccttcttcctctacagcaagctcaccgtggacaagagcaggtggcagcaggggaacgtc ttctcatgctccgtgatgcatgaggctctgcacaaccactacacgcagaagagcctctccctgtctccgggtaaagcggatccttcg aacctgctcccatcctgggccattaccttaatctcagtaaatggaatttttgtgatatgctgcctgacctactgctttgccccaagatgca gagagagaaggaggaatgagagattgagaagggaaagtgtacgccctgtataaatcgatactcgag AA
5B9 scFv-hmtIgG1-hCD80
(SEQ ID NO: 572)
MRFSAQLLGLLVLWIPGSTADIVMTQAAFSNPVTLGTSASISCRSSKS

LLHSNGITYLYWYLQKPGQSPQLLIYQMSNLASGVPDRFSSGSGTDFTLRISRVEA

-continued

EDVGVYYCAQNLELPLTFGAGTKLELKRGGGGSGGGGSGGGGSSQVQLKQSGPG

LVQSSQSLSITCTVSGFSLTTYAVHWVRQSPGKGLEWLGVIWSGGITDYNAAFISR

LSITIKDDSKSQVFFKMNSLQPNDTAIYYCARNGGDNYPYYYAMDYWGQGTSVTV

SSDLEPKSSDKTHTSPPSPAPELLGGSSVFLFPPKPKDTLMISRTPEVTCVVVDVSHE

DPEVKFNWYVDGVEVHNAKTKPREEQYNSTYRVVSVLTVLHQDWLNGKEYKCK

VSNKALPAPIEKTISKAKGQPREPQVYTLPPSRDELTKNQVSLTCLVKGFYPSDIAV

EWESNGQPENNYKTTPPVLDSDGSFFLYSKLTVDKSRWQQGNVFSCSVMHEALH

NHYTQKSLSLSPGKADPSNLLPSWAITLISVNGIFVICCLTYCFAPRCRERRRNERLR

RESVRPV

NT
2e12 scFv WTH CH2 CH3 (2e12 scFv-WthIgG-CD80)
(SEQ ID NO: 573)
aagcttatggattttcaagtgcagattttcagcttcctgctaatcagtgcttcagtcataatgtccagaggagtcg acattgtgctcacccaatctccagcttctttggctgtgtctctaggtcagagagccaccatctcctgcagagccagtgaaagtgttgaa tattatgtcacaagtttaatgcagtggtaccaacagaaaccaggacagccacccaaactcctcatctctgctgcatccaacgtagaat ctggggtccctgccaggtttagtggcagtgggtctgggacagacttcagcctcaacatccatcctgtggaggaggatgatattgcaa tgtatttctgtcagcaaagtaggaaggttccttggacgttcggtggaggcaccaagctggaaatcaaacggggtggcggtggctcg ggcggaggtgggtcgggtggcggcggatctcaggtgcagctgaaggagtcaggacctggcctggtggcgccctcacagagcc tgtccatcacatgcaccgtctcagggttctcattaaccggctatggtgtaaactgggttcgccagcctccaggaaagggtctggagt ggctgggaatgatatggggtgatggaagcacagactataattcagctctcaaatccagactgagcatcaccaaggacaactccaa gagccaagttttcttaaaaatgaacagtctgcaaactgatgacacagccagatactactgtgccagagatggttatagtaactttcatt actatgttatggactactggggtcaaggaacctcagtcaccgtctcctcagatctggagcccaaatcttgtgacaaaactcacacatg cccaccgtgcccagcacctgaactcctggggggaccgtcagtcttcctcttccccccaaaacccaaggacaccctcatgatctccc ggacccctgaggtcacatgcgtggtggtggacgtgagccacgaagaccctgaggtcaagttcaactggtacgtggacggcgtgg aggtgcataatgccaagacaaagccgcgggaggagcagtacaacagcacgtaccgtgtggtcagcgtcctcaccgtcctgcacc aggactggctgaatggcaaggagtacaagtgcaaggtctccaacaaagccctcccagcccccatcgagaaaaccatctccaaag ccaaagggcagccccgagaaccacaggtgtacaccctgcccccatcccgggatgagctgaccaagaaccaggtcagcctgacc tgcctggtcaaaggcttctatcccagcgacatcgccgtggagtgggagagcaatgggcagccggagaacaactacaagaccac gcctcccgtgctggactccgacggctccttcttcctctacagcaagctcaccgtggacaagagcaggtggcagcaggggaacgtc ttctcatgctccgtgatgcatgaggctctgcacaaccactacacgcagaagagcctctccctgtctccgggtaaagcggatccttcg aacctgctcccatcctgggccattaccttaatctcagtaaatggaatttttgtgatatgctgcctgacctactgctttgccccaagatgca gagagagaaggaggaatgagagattgagaagggaaagtgtacgccctgtataaatcgat 2e12 scFv WTH CH2 CH3 2e12 scFv-WthIgG-CD80
(SEQ ID NO: 574)
mdfqvqifsfllisasvimsrgvdivltqspaslavslgqratiscrasesveyyvtslmqwyqqkpgqp pkllisaasnvesgvparfsgsgsgtdfslnihpveeddiamyfcqqsrkvpwtfgggtkleikrggggsggggsggggsqvq lkesgpglvapsqslsitctvsgfsltgygvnwvrqppgkglewlgmiwgdgstdynsalksrlsitkdnsksqvflkmnslqt ddtaryycardgysnfhyyvmdywgqgtsvtvssdlepkscdkthtcppcpapellggpsvflfppkpkdtlmisrtpevtc vvvdvshedpevkfnwyvdgvevhnaktkpreeqynstyrvvsvltvlhqdwlngkeykckvsnkalpapiektiskakg qprepqvytlppsrdeltknqvsltclvkgfypsdiavewesngqpennykttppvldsdgsfflyskltvdksrwqqgnvfsc svmhealhnhytqkslslspgkadpsnllpswaitlisvngifviccltycfaprcrerrrnerlrresvrpv NT
2H7-human IgE Fc (CH2-CH3-CH4)
(SEQ ID NO: 575)

```
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaaggtggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctctgatcacgtctgctccaggacttcaccccgcccaccgtgaagatcttaca gtcgtcctgcgacggcggcgggcacttccccccgaccatccagctcctgtgcctcgtctctgggtacaccccagggactatcaac atcacctggctggaggacgggcaggtcatggacgtggacttgtccaccgcctctaccacgcaggagggtgagctggcctccaca caaagcgagctcaccctcagccagaagcactggctgtcagaccgcacctacacctgccaggtcacctatcaaggtcacacctttg aggacagcaccaagaagtgtgcagattccaacccgagaggggtgagcgcctacctaagccggcccagcccgttcgacctgttca tccgcaagtcgcccacgatcacctgtctggtggtggacctggcacccagcaagggggaccgtgaacctgacctggtcccgggcca gtgggaagcctgtgaaccactccaccagaaaggaggagaagcagcgcaatgcacgttaaccgtcacgtccaccctgccggtg ggcacccgagactggatcgagggggagacctaccagtgcagggtgacccacccccacctgcccagggccctcatgcggtcca cgaccaagaccagcggcccgcgtgctgccccggaagtctatgcgtttgcgacgccggagtggccggggagccgggacaagcg caccctcgcctgcctgatccagaacttcatgcctgaggacatctcggtgcagtggctgcacaacgaggtgcagctcccggacgcc cggcacagcacgacgcagccccgcaagaccaagggctccggcttcttcgtcttcagccgcctggaggtgaccagggccgaatg ggagcagaaagatgagttcatctgccgtgcagtccatgaggcagcgagcccctcacagaccgtccagcgagcggtgtctgtaaat cccggtaaatgataatctaga
```
AA  
2H7 scFv IgE (CH3-CH3-CH4)  
(SEQ ID NO: 576)  
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkggggsggggsggggssqaylqqsgae lvrpgasvkmsckasgytftsynmhwvkqtprqglewigaiypgngdtsynqktkgkatltvdkssstaymqlssltsedsa vyfcarvvyysnsywyfdvwgtgttvtvsdhvcsrdftpptvkilqsscdgghfpptiqllclvsgytpgtiniwledgeqvm dvdlstasttqegelastqseltlsqkhwlsdrtytcqvtyqghtfedstkkcadsnprgvsaylsrpspfdlfirksptitclvvdla pskgtvnltwsrasgkpvnhstrkeekqrngtltvtstlpvgtrdwiegetyqcrvthphlpralmrssttktsgpraapevyafat pewpgsrdkrtlacliqnfmpedisvqwlhnevqlpdarhsttqprktkgsgffvfsrlevtraeweqkdeficravheaasps qtvqravsvnpgk NT  
2H7 scFv MH (SSS) MCH2WTCH3  
(SEQ ID NO: 577)  
```
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct
```

-continued atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatccccaccgtc ccagcacctgaactcctgggggatcgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagcccttccagcccccatcgagaaaacaatctccaaagccaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga AA  
2H7 scFv MH (SSS) MCH2WTCH3  
(SEQ ID NO: 578)

mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqktkgkatltvdkssstaymqlssltsedsa vyfcarvvyysnsywyfdvwgrgttvtvssdqepkssdkthtsppspapellggssvflfppkpkdtlmisrtpevtcvvvdv shedpevkfnwyvdgvevhnaktkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvflth ealhnhytqkslslspgk NT  
5B9 scFv MTHWTCH2CH3  
(SEQ ID NO: 579)  
aagcttgccgccatgaggttctctgctcagcttctggggctgcttgtgctctggatccctggatccactgcaga tattgtgatgacgcaggctgcattctccaatccagtcactcttggaacatcagcttccatctcctgcaggtctagtaagagtctcctaca tagtaatggcatcactttatttgtattggtatctgcagaagccaggccagtctcctcagctcctgatttatcagatgtccaaccttgcctca ggagtcccagacaggttcagtagcagtgggtcaggaactgatttcacactgagaatcagcagagtggaggctgaggatgtgggtg tttattactgtgctcaaaatctagaacttccgctcacgttcggtgctgggaccaagctggagctgaaacggggtggcggtggctcgg gcggtggtgggtcgggtggcggcggatcgtcacaggtgcagctgaagcagtcaggacctggcctagtgcagtcctcacagagc ctgtccatcacctgcacagtctctggtttctcattaactacctatgctgtacactgggttcgccagtctccaggaaagggtctggagtg gctgggagtgatatggagtggtggaatcacagactataatgcagctttcatatccagactgagcatcaccaaggacgattccaaga gccaagttttcttaaaatgaacagtctgcaacctaatgacacagccatttattactgtgccagaaatgggggtgataactacccttatt actatgctatggactactggggtcaaggaacctcagtcaccgtctcctcgatcaggagcccaaatcttctgacaaaactcacacatc cccaccgtcccagcacctgaactcctgggggaccgtcagtcttcctcttccccccaaaacccaaggacaccctcatgatctccc ggacccctgaggtcacatgcgtggtggtgacgtgagccacgaagaccctgaggtcaagttcaactggtacgtggacggcgtgg aggtgcataatgccaagacaaagccgcgggaggagcagtacaacagcacgtaccgtgtggtcagcgtcctcaccgtcctgcacc aggactggctgaatggcaaggagtacaagtgcaaggtctccaacaaagcccttccagcccccatcgagaaaacaatctccaaag ccaaagggcagccccgagaaccacaggtgtacaccctgcccccatcccgggatgagctgaccaagaaccaggtcagcctgacc tgcctggtcaaaggcttctatcccagcgacatcgccgtggagtgggagagcaatgggcagccggagaacaactacaagaccac gcctcccgtgctggactccgacggctccttcttcctctacagcaagctcaccgtggacaagagcaggtggcagcaggggaacgtc ttctcatgctccgtgatgcatgaggctctgcacaaccactacacgcagaagagcctctccctgtctccgggtaaatgatctaga

AA

5B9 ScFv MTHWTCH2CH3
(SEQ ID NO: 580)
MRFSAQLLGLLVLWIPGSTADIVMTQAAFSNPVTLGTSASISCRSSKS

LLHSNGITYLYWYLQKPGQSPQLLIYQMSNLASGVPDRESSSGSGTDFTLRISRVEA

EDVGVYYCAQNLELPLTFGAGTKLELKRGGGGSGGGGSGGGGSSQVQLKQSGPG

LVQSSQSLSITCTVSGFSLTTYAVHWVRQSPGKGLEWLGVIWSGGITDYNAAFISR

LSITKDDSKSQVFFKMNSLQPNDTAIYYCARNGGDNYPYYYAMDYWGQGTSVTV

SSDQEPKSSDKTHTSPPSPAPELLGGPSVFLFPPKPKDTLMISRTPEVTCVVVDVSHE

DPEVKFNWYVDGVEVHNAKTKPREEQYNSTYRVVSVLTVLHQDWLNGKEYKCK

VSNKALPAPIEKTISKAKGQPREPQVYTLPPSRDELTKNQVSLTCLVKGFYPSDIAV

EWESNGQPENNYKTTPPVLDSDGSFFLYSKLTVDKSRWQQGNVFSCSVMHEALH

NHYTQKSLSLSPGK

Human IgG1 hinge mutations
2H7 ScFv- MTH (CSS) WTCH2CH3
(SEQ ID NO: 581)
Nucleotide:
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttgtgacaaaactcacacatcccaccgtc cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga 2H7 ScFv- MTH (CSS) WTCH2CH3 protein
(SEQ ID NO: 582):
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtkleldggggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtssdqepkscdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvmh ealhnhytqkslslspgk 2H7 ScFv- MTH (SCS) WTCH2CH3
(SEQ ID NO: 583):

Nucleotide:
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccaccccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatgcccaccgtc ccagcacctgaactcctgggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga 2H7 scFv- MTH (SCS) WTCH2CH3 Protein
(SEQ ID NO: 584):
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtcppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvmh ealhnhytqkslslspgk 2H7 scFv- MTH (SSC) WTCH2CH3
(SEQ ID NO: 585):
Nucleotide:
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccaccccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatgcccaccgtg cccagcacctgaactcctgggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata -continued atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga 2H7 scFv- MTH (SSC) WTCH2CH3 Protein
(SEQ ID NO: 586):
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtsppcpapellggpsvflfppkpkdtlmisrtpevtcvvvdv shedpevkfnwyvdgvevhnakttkpreeqynstyrvvsvltvlhqdwlngkeykckvsnkalpapiektiskakgqprep qvytlppsrdeltknqvsltclvkgfypsdiavewesngqpennykttppvldsdgsfflysklitvdksrwqqgnvfscsvmh ealhnhytqkslslspgk HIgGMHcys1
(SEQ ID NO: 587)
gtt gtt gat cag gag ccc aaa tct tct gac aaa act cac aca tg HIgGMHcys2
(SEQ ID NO: 588)
gtt gtt gat cag gag ccc aaa tct tgt gac aaa act cac aca tct cca ccg tgc HIgGMHcys3
(SEQ ID NO: 589)
gtt gtt gat cag gag ccc aaa tct tgt gac aaa act cac aca tgt cca ccg tcc cca gca cct NT
HuIgG1 MTCH3Y405
(SEQ ID NO: 590)
gggcagccccgagaaccacaggtgtacaccctgcccccatcccgggaggagatgaccaagaaccaggt cagcctgacctgcctggtcaaaggcttctatcccagcgacatcgccgtggagtgggagagcaatgggcagccggagaacaacta caagaccacgcctcccgtgctggactccgacggctccttctacctctatagcaagctcaccgtggacaagagcaggtggcagcag gggaacgtcttctcatgctccgtgatgcatgaggctctgcacaaccactacacgcagaagagcctctccctgtccccgggtaaatg a AA
HuIgG1 MTCH3Y405
(SEQ ID NO: 591)
GQPREPQVYTLPPSREEMTKNQVSLTCLVKGFYPSDIAVEWESNGQ

PENNYKTTPPVLDSDGSFYLYSKLTVDKSRWQQGNVFSCSVMHEALHNHYTQKS

LSLSPGK

NT
HuIgG1 MTCH3A405
(SEQ ID NO: 592)
gggcagccccgagaaccacaggtgtacaccctgcccccatcccgggaggagatgaccaagaaccaggt cagcctgacctgcctggtcaaaggcttctatcccagcgacatcgccgtggagtgggagagcaatgggcagccggagaacaacta caagaccacgcctcccgtgctggactccgacggctccttcgccctctatagcaagctcaccgtggacaagagcaggtggcagca ggggaacgtcttctcatgctccgtgatgcatgaggctctgcacaaccactacacgcagaagagcctctccctgtccccgggtaaat ga AA
HuIgG1 MTCH3A405
(SEQ ID NO: 593)

```
GQPREPQVYTLPPSREEMTKNQVSLTCLVKGFYPSDIAVEWESNGQ

PENNYKTTPPVLDSDGSFALYSKLTVDKSRWQQGNVFSCSVMHEALHNHYTQKS

LSLSPGK

NT
HuIgG1 MTCH3A407
(SEQ ID NO: 594)
Gggcagccccgagaaccacaggtgtacaccctgcccccatcccgggaggagatgaccaagaaccaggt cagcctgacctgcctggtcaaaggcttctatcccagcgacatcgccgtggagtgggagagcaatgggcagccggagaacaacta caagaccacgcctcccgtgctggactccgacggctccttcttcctcgccagcaagctcaccgtggacaagagcaggtggcagca ggggaacgtcttctcatgctccgtgatgcatgaggctctgcacaaccactacacgcagaagagcctctccctgtccccgggtaaat ga AA
HuIgG1 MTCH3A407
(SEQ ID NO: 595)
GQPREPQVYTLPPSREEMTKNQVSLTCLVKGFYPSDIAVEWESNGQ

PENNYKTTPPVLDSDGSFFLASKLTVDKSRWQQGNVFSCSVMHEALHNHYTQKSL

SLSPGK

NT
HuIgG1 MTCH3Y405A407
(SEQ ID NO: 596)
gggcagccccgagaaccacaggtgtacaccctgcccccatcccgggaggagatgaccaagaaccaggt cagcctgacctgcctggtcaaaggcttctatcccagcgacatcgccgtggagtgggagagcaatgggcagccggagaacaacta caagaccacgcctcccgtgctggactccgacggctccttctacctcgccagcaagctcaccgtggacaagagcaggtggcagca ggggaacgtcttctcatgctccgtgatgcatgaggctctgcacaaccactacacgcagaagagcctctccctgtccccgggtaaat ga AA
HuIgG1 MTCH3Y405A407
(SEQ ID NO: 597)
GQPREPQVYTLPPSREEMTKNQVSLTCLVKGFYPSDIAVEWESNGQ

PENNYKTTPPVLDSDGSFYLASKLTVDKSRWQQGNVFSCSVMHEALHNHYTQKS

LSLSPGK

NT
HuIgG1 MTCH3A405A407
(SEQ ID NO: 598)
gggcagccccgagaaccacaggtgtacaccctgcccccatcccgggaggagatgaccaagaaccaggt cagcctgacctgcctggtcaaaggcttctatcccagcgacatcgccgtggagtgggagagcaatgggcagccggagaacaacta caagaccacgcctcccgtgctggactccgacggctccttcgccctcgccagcaagctcaccgtggacaagagcaggtggcagc aggggaacgtcttctcatgctccgtgatgcatgaggctctgcacaaccactacacgcagaagagcctctccctgtccccgggtaaa tga AA
HuIgG1 MTCH3A405A407
(SEQ ID NO: 599)
gqprepqvytlppsreemtknqvsltclvkgfypsdiavewesngqpennykttppvldsdgsfalask ltvdksrwqqgnvfscsvmhealhnhytqkslslspgk NT
2H7 scFv MTH (SSS) WTCH2MTCH3Y405
(SEQ ID NO: 600)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg
``` ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatcccaccgtc cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggaggagatgaccaagaaccaggtcagcctgacctgcctggt caaaggcttctatcccagcgacatcgccgtggagtgggagagcaatgggcagccggagaacaactacaagaccacgcctcccg tgctggactccgacggctccttctacctctatagcaagctcaccgtggacaagagcaggtggcagcaggggaacgtcttctcatgc tccgtgatgcatgaggctctgcacaaccactacacgcagaagagcctctccctgtcccgggtaaatgatctaga AA
2H7 scFv MTH (SSS) WTCH2MTCH3Y405
(SEQ ID NO: 601)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsyflqkfkgkatltvdkssstaymqlssltsedsa vyfcarvvyysnsywyfdvwgtgttvtvssdqepkssdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsreemtknqvsltclvkgfypsdiavewesngqpennykttppvldsdgsfylyskltvdksrwqqgnvfscsvm healhnhytqkslslspgk NT
2H7 scFv MTH (SSS) WTCH2MTCH3A405
(SEQ ID NO: 602)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatcccaccgtc cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggaggagatgaccaagaaccaggtcagcctgacctgcctggt caaaggcttctatcccagcgacatcgccgtggagtgggagagcaatgggcagccggagaacaactacaagaccacgcctcccg

```
AA
2H7 scFv MTH (SSS) WTCH2MTCH3A405
(SEQ ID NO: 603)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsreemtknqvsltclvkgfypsdiavewesngqpennykttppvldsdgsfalyskltvdksrwqqgnvfscsvm healhnhytqkslslspgk NT
2H7 scFv MTH (SSS) WTCH2MTCH3A407
(SEQ ID NO: 604)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgcccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatcccaccgtc cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggaggagatgaccaagaaccaggtcagcctgacctgcctggt caaaggcttctatcccagcgacatcgccgtggagtgggagagcaatgggcagccggagaacaactacaagaccacgcctcccg tgctggactccgacggctccttcttcctcgccagcaagctcaccgtggacaagagcaggtggcagcaggggaacgtcttctcatg ctccgtgatgcatgaggctctgcacaaccactacacgcagaagagcctctccctgtccccgggtaaatga AA
2H7 scFv MTH (SSS) WTCH2MTCH3A407
(SEQ ID NO: 605)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsreemtknqvsltclvkgfypsdiavewesngqpennykttppvldsdgsfflaskltvdksrwqqgnvfscsvm healhnhytqkslslspgk NT
2H7 scFv MTH (SSS) WTCH2MTCH3Y405A407
```

-continued (SEQ ID NO: 606)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgcccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatcccaccgtc cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggaggagatgaccaagaaccaggtcagcctgacctgcctggt caaaggcttctatcccagcgacatcgccgtggagtgggagagcaatgggcagccggagaacaactacaagaccacgcctcccg tgctggactccgacggctccttctacctcgccagcaagctcaccgtggacaagagcaggtggcagcaggggaacgtcttctcatg ctccgtgatgcatgaggctctgcacaaccactacacgcagaagagcctctccctgtccccgggtaaatga AA
2H7 scFv MTH (SSS) WTCH2MTCH3Y405A407
(SEQ ID NO: 607)
mdfqvqifsfllisasviiargqivlsqspailsaspgekvtmtcrasssvsymhwyqqkpgsspkpwiy apsnlasgvparfsgsgsgtsysltisrveaedaatyycqqwsfrippt fgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsreemtknqvsltclvkgfypsdiavewesngqpennykttppvldsdgsfylaskltvdksrwqqgnvfscsvm healhnhytqkslslspgk NT
2H7 scFv MTH (SSS) WTCH2MTCH3A405A407
(SEQ ID NO: 608)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgcccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatcccaccgtc cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata -continued

```
atgccaagacaaagccgcggggaggagcagtacaacagcacgtaccgtgtggtcagcgtcctcaccgtcctgcaccaggactgg ctgaatggcaaggagtacaagtgcaaggtctccaacaaagcccctcccagcccccatcgagaaaacaatctccaaagccaaggg cagccccgagaaccacaggtgtacaccctgcccccatcccgggaggagatgaccaagaaccaggtcagcctgacctgcctggt caaaggcttctatcccagcgacatcgccgtggagtgggagagcaatgggcagccggagaacaactacaagaccacgcctcccg tgctggactccgacggctccttcgccctcgccagcaagctcaccgtggacaagagcaggtggcagcaggggaacgtcttctcatg ctccgtgatgcatgaggctctgcacaaccactacacgcagaagagcctctccctgtccccgggtaaatga
```

AA
2H7 scFv MTH (SSS) WTCH2MTCH3A405A407
(SEQ ID NO: 609)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtsppspapellggpsvflfppkpkdtlmisrtpevtcvvvdv shedpevkfnwyvdgvevhnaktkpreeqynstyrvvsvltvlhqdwlngkeykckvsnkalpapiektiskakgqprep qvytlppsreemtknqvsltclvkgfypsdiavewesngqpennykttppvldsdgsfalaskltvdksrwqqgnvfscsvm healhnhytqkslslspgk NT
2H7 scFv MTH (scc) WTCH2CH3
(SEQ ID NO: 610)
```
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatgcccaccgtg cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagcccctcccagcccccatcgagaaaacaatctccaaagccaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga AA
2H7 scFv MTH (SCC) WTCH2CH3
(SEQ ID NO: 611)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkssdkthtcppcpapellggpsvflfppkpkdtlmisrtpevtcvvvdv -continued shedpevkfnwyvdgvevhnakttkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvmh ealhnhytqkslslspgk NT
2117 scFv MTH (CSC) WTCH2CH3
(SEQ ID NO: 612)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccaccccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttgtgacaaaactcacacatctccaccgtg cccagcacctgaactcctggggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga AA
2H7 scFv MTH (CSC) WTCH2CH3
(SEQ ID NO: 613)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdksssstaymqlssltsedsa vyfcarvvyysnsywyfdvwgtgttvtvssdqepkscdkthtsppcpapellggpsvflfppkpkdtlmisrtpevtcvvvdv shedpevkfnwyvdgvevhnakttkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvmh ealhnhytqkslslspgk NT
2H7 scFv MTH (CCS) WTCH2CH3
(SEQ ID NO: 614)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccaccccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc -continued

```
tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttgtgacaaaactcacacatgtccaccgtc cccagcacctgaactcctgggggaccgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga
```

AA
2H7 scFv MTH (CCS) WTCH2CH3
(SEQ ID NO: 615)

mdfqvqifsfllisasviiargqivlsqspailsaspgekvtmtcrasssvsymhwyqqkpgssppkwiy apsnlasgvparfsgsgsgtsysltisrveaedaatyycqqwsfnpptfgagtklelkdgggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvssdqepkscdkthtcppspapellggpsvflfppkpkdflmisrtpevtcvvvdv shedpevkfnwyvdgvevhnaktkpreeqynstyrvvsvltvlhqdwlngkeykckvsnkalpapiektiskakgqprep qvytlppsrdeltknqvsltclvkgfypsdiavewesngqpennykttppvldsdgsfflysklvtdksrwqqgnvfscsvmh ealhnhytqkslslspgk NT
HuIgAHIgA-T4-ORF
(SEQ ID NO: 616)

tgatcagccagttccctcaactccacctaccccatctccctcaactccacctaccccatctccctcatgctgcc accccgactgtcactgcaccgaccggccctcgaggacctgctcttaggttcagaagcgatcctcacgtgcacactgaccggcct gagagatgcctcaggtgtcaccttcacctggacgcctcaagtgggaagagcgctgttcaaggaccacctgaccgtgacctctgt ggctgctacagcgtgtccagtgtcctgccgggctgtgccgagccatggaaccatgggaagaccttcacttgcactgctgcctaccc cgagtccaagaccccgctaaccgccacctctcaaaatccggaaacacattccggcccgaggtccacctgctgccgccgccgtc ggaggagctggccctgaacgagctggtgacgctgacgtgcctggcacgtggcttcagccccaaggatgtgctggttcgctggct gcagggtcacaggagctgccccgcgagaagtacctgacttgggcatcccggcaggagcccagccagggcaccaccaccttc gctgtgaccagcatactgcgcgtggcagccgaggactggaagaaggggggacaccttctcctgcatggtgggccacgaggccct gccgctggccttcacacagaagaccatcgaccgcttggcgggtaaacccacccatgtcaatgtgtctgttgtcatggcggaggtgg acgcggatccttcgaac AA
HuIgAHIgA-T4-ORF
(SEQ ID NO: 617)

Dqpvpstpptpspstpptpspscchprlslhrpaledlllgseailtctltglrdasgvtftwtpssgksavqg ppdrdlcgcysvssvlpgcacpwnhgktftctaaypesktpltatlsksgntfrpevhllpppseelalnelvtltclargfspkdvl vrwlqgsqelprekyltwasrqepsqgttttfavtsilrvaaedwkkgdtfscmvghealplaftqktidrlagkpthvnvsvvm aevdadpsn NT
HuIgAHIgA-T4-ORF
(SEQ ID NO: 618)

tgatcagccagttccctcaactccacctaccccatctccctcaactccacctaccccatctccctcatgctgcc accccgactgtcactgcaccgaccggccctcgaggacctgctcttaggttcagaagcgatcctcacgtgcacactgaccggcct gagagatgcctcaggtgtcaccttcacctggacgcctcaagtgggaagagcgctgttcaaggaccacctgaccgtgacctctgt -continued ggctgctacagcgtgtccagtgtcctgccgggctgtgccgagccatggaaccatgggaagaccttcacttgcactgctgcctaccc cgagtccaagaccccgctaaccgccaccctctcaaaatccggaaacacattccggcccgaggtccacctgctgccgccgccgtc ggaggagctggccctgaacgagctggtgacgctgacgtgcctggcacgtggcttcagccccaaggatgtgctggttcgctggct gcaggggtcacaggagctgccccgcgagaagtacctgacttgggcatcccggcaggagcccagccagggcaccaccaccttc gctgtgaccagcatactgcgcgtggcagccgaggactggaagaagggggacaccttctcctgcatggtgggccacgaggccct gccgctggccttcacacagaagaccatcgaccgcttggcgggtaaacccacccatgtcaatgtgtctgttgtcatggcggaggtgg acgcggatccttcgaac AA
HuIgAHIgA-T4-ORF
(SEQ ID NO: 619)
dqpvpstpptpspstpptpspscchprlslhrpaledllllgseailtctltglrdasgvtftwtpssgksavqg ppdrdlcgcysvssvlpgcaepwnhgktftctaaypesktpltatlsksgntfrpevhllpppseelalnelvtltclargfspkdvl vrwlqgsqelprekyltwasrqepsqgttttfavtsilrvaaedwkkgdtfscmvghealplaftqktidrlagkpthvnvsvvm aevdadpsn NT
1D8-IgAH IgA-T4-CD80
(SEQ ID NO: 620)
aagcttatggattttcaagtgcagattttcagcttcctgctaatcagtgcttcagtcataatgtccagaggagtcg acattgtgctcactcagtctccaacaaccatagctgcatctccaggggagaaggtcaccatcacctgccgtgccagctccagtgtaa gttacatgtactggtaccagcagaagtcaggcgcctcccctaaactctggatttatgacacatccaagctggcttctggagttccaaa tcgcttcagtggcagtgggtctgggacctcttattctctcgcaatcaacaccatggagactgaagatgctgccacttattactgtcagc agtggagtagtactccgctcacgttcgggtctgggaccaagctggagatcaaacggggtggcggtggctcgggcggtggtgggt cgggtggcggcggatctcaggtgcagctgaaggaggcaggacctggcctggtgcaaccgacacagaccctgtccctcacatgc actgtctctgggttctcattaaccagcgatggtgtacactggattcgacagcctccaggaaagggtctggaatggatgggaataatat attatgatggaggcacagattataattcagcaattaaatccagactgagcatcagcagggacacctccaagagccaagttttcttaaa aatcaacagtctgcaaactgatgacacagccatgtattactgtgccagaatccactttgattactggggccaaggagtcatggtcaca gtctcctctgatcagccagttccctcaactccacctaccccatctccctcaactccacctaccccatctccctcatgctgccaccccg actgtcactgcaccgaccggccctcgaggacctgctcttaggttcagaagcgatcctcacgtgcacactgaccggcctgagagat gcctcaggtgtcaccttcacctggacgccctcaagtgggaagagcgctgttcaaggaccacctgaccgtgacctctgtggctgcta cagcgtgtccagtgtcctgccgggctgtgccgagccatggaaccatgggaagaccttcacttgcactgctgcctaccccgagtcca agaccccgctaaccgccaccctctcaaaatccggaaacacattccggcccgaggtccacctgctgccgccgccgtcggaggag ctggccctgaacgagctggtgacgctgacgtgcctggcacgtggcttcagccccaaggatgtgctggttcgctggctgcaggggt cacaggagctgccccgcgagaagtacctgacttgggcatcccggcaggagcccagccagggcaccaccaccttcgctgtgacc agcatactgcgcgtggcagccgaggactggaagaagggggacaccttctcctgcatggtgggccacgaggccctgccgctggc cttcacacagaagaccatcgaccgcttggcgggtaaacccacccatgtcaatgtgtctgttgtcatggcggaggtggacgcggatc cttcgaacaacctgctcccatcctgggccattaccttaatctcagtaaatggaatttttgtgatatgctgcctgacctactgctttgcccc aagatgcagagagagaaggaggaatgagagattgagaagggaaagtgtacgccctgtataaatcgatac AA
1D8 scFv IgAH IgA-T4-CD80
(SEQ ID NO: 621)
mdfqvqifsfllisasvimsrgvdivltqspttiaaspgekvtitcrassssvsymywyqqksgaspklwiy dtsklasgvpnrfsgsgsgtsyslaintmetedaatyycqqwsstpltfgsgtkleikrggggsggggsggggsqvqlkeagpg lvqptqtlsltctvsgfsltsdgvhwirqppgkglewmgiiyydggtdynsaiksrlsisrdtsksqvflkinslqtddtamyyca rihfdywgqgvmvtvssdqpvpstpptpspstpptpspscchprlslhrpaledllllgseailtctltglrdasgvtftwtpssgks -continued
avqgppdrdlcgcysvssvlpgcacpwnhgktftctaaypesktpltatlsksgntfrpevhllpppseelalnelvtltclargfs pkdvlvrwlqgsqelprekyltwasrqepsqgtttfavtsilrvaaedwkkgdtfscmvghealplaftqktidrlagkpthvnv svvmaevdadpsnnllpswaitlisvngifviccltycfaprcrerrrnerlrresvrpv NT
human IgE Fc (CH2-CH3-CH4) ORF
(SEQ ID NO: 622):
tgatcacgtctgctccagggacttcaccccgcccaccgtgaagatcttacagtcgtcctgcgacggcggcg ggcacttccccccgaccatccagctcctgtgcctcgtctctgggtacaccccagggactatcaacatcacctggctggaggacgg gcaggtcatggacgtggacttgtccaccgcctctaccacgcaggagggtgagctggcctccacacaaagcgagctcaccctcag ccagaagcactggctgtcagaccgcacctacacctgccaggtcacctatcaaggtcacacctttgaggacagcaccaagaagtgt gcagattccaacccgagaggggtgagcgcctacctaagccggcccagcccgttcgacctgttcatccgcaagtcgcccacgatc acctgtctggtggtggacctggcacccagcaaggggaccgtgaacctgacctggtcccgggccagtgggaagcctgtgaacca ctccaccagaaaggaggagaagcagcgcaatggcacgttaaccgtcacgtccaccctgccggtgggcacccgagactggatcg agggggagacctaccagtgcagggtgacccacccccacctgcccagggccctcatgcggtccacgaccaagaccagcggccc gcgtgctgccccggaagtctatgcgtttgcgacgccggagtggccggggagccgggacaagcgcaccctcgcctgcctgatcc agaacttcatgcctgaggacatctcggtgcagtggctgcacaacgaggtgcagctcccggacgcccggcacagcacgacgcag ccccgcaagaccaagggctccggcttcttcgtcttcagccgcctggaggtgaccagggccgaatgggagcagaaagatgagttc atctgccgtgcagtccatgaggcagcgagcccctcacagaccgtccagcgagcggtgtctgtaaatcccggtaaagcggatcctt cgaa AA
human IgE Fc (CH2-CH3-CH4) ORF
(SEQ ID NO: 623):
dhvcsrdftpptvkilqsscdggghfpptiqllclvsgytpgtinitwledgqvmdvdlstasttqegelast qseltlsqkhwlsdrtytcqvtyqghtfedstkkcadsnprgvsaylsrpspfdlfirksptitclvvdlapskgtvnltwsrasgk pvnhstrkeekqrngtltvtstlpvgtrdwiegetyqcrvthphlpralmrsttktsgpraapevyafatpewpgsrdkrtlacliq nfmpedisvqwlhnevqlpdarhsttqprktkgsgffvfsrlevtraeweqkdeficravhcaaspsqtvqravsvnpgkadp s NT
1D8 scFv-human IgE Fc (CH2-CH3-CH4)-CD80
(SEQ ID NO: 624)
aagcttatggattttcaagtgcagattttcagcttcctgctaatcagtgcttcagtcataatgtccagaggagtcg acattgtgctcactcagtctccaacaaccatagctgcatctccaggggagaaggtcaccatcacctgccgtgccagctccagtgtaa gttacatgtactggtaccagcagaagtcaggcgcctcccctaaactctggatttatgacacatccaagctggcttctggagttccaaa tcgcttcagtggcagtgggtctgggacctcttattctctcgcaatcaacaccatggagactgaagatgctgccacttattactgtcagc agtggagtagtactccgctcacgttcgggtctgggaccaagctggagatcaaacggggtggcggtggctcgggcggtggtgggt cgggtggcggcggatctcaggtgcagctgaaggaggcaggacctggcctggtgcaaccgacacagaccctgtccctcacatgc actgtctctgggttctcattaaccagcgatggtgtacactggattcgacagcctccaggaaagggtctggaatggatgggaataatat attatgatggaggcacagattataattcagcaattaaatccagactgagcatcagcagggacacctccaagagccaagttttcttaaa aatcaacagtctgcaaactgatgacacagccatgtattactgtgccagaatccactttgattactggggccaaggagtcatggtcaca gtctcctctgatcacgtctgctccagggacttcaccccgcccaccgtgaagatcttacagtcgtcctgcgacggcggcgggcacttc cccccgaccatccagctcctgtgcctcgtctctgggtacaccccagggactatcaacatcacctggctggaggacgggcaggtca tggacgtggacttgtccaccgcctctaccacgcaggagggtgagctggcctccacacaaagcgagctcaccctcagccagaagc actggctgtcagaccgcacctacacctgccaggtcacctatcaaggtcacacctttgaggacagcaccaagaagtgtgcagattcc aacccgagaggggtgagcgcctacctaagccggcccagcccgttcgacctgttcatccgcaagtcgcccacgatcacctgtctgg tggtggacctggcacccagcaaggggaccgtgaacctgacctggtcccgggccagtgggaagcctgtgaaccactccaccaga -continued aaggaggagaagcagcgcaatggcacgttaaccgtcacgtccaccctgccggtgggcacccgagactggatcgagggggaga cctaccagtgcagggtgacccacccccacctgcccagggccctcatgcggtccacgaccaagaccagcggcccgcgtgctgcc ccggaagtctatgcgtttgcgacgccggagtggccggggagccgggacaagcgcaccctcgcctgcctgatccagaacttcatg cctgaggacatctcggtgcagtggctgcacaacgaggtgcagctcccggacgcccggcacagcacgacgcagccccgcaaga ccaagggctccggcttcttcgtcttcagccgcctggaggtgaccagggccgaatgggagcagaaagatgagttcatctgccgtgc agtccatgaggcagcgagcccctcacagaccgtccagcgagcggtgtctgtaaatcccggtaaagcggatccttcgaagctccca tcctgggccattaccttaatctcagtaaatggaatttttgtgatatgctgcctgacctactgctttgccccaagatgcagagagagaag gaggaatgagagattgagaagggaaagtgtacgccctgtataaatcgata AA 1D8-scFv-human IgE Fc (CH2-CH3-CH4)-CD80
(SEQ ID NO: 625)
mdfqvqifsfllisasvimsrgvdivhqspttiaaspgekvtitcrasssvsymywyqqksgaspklwiy dtsklasgvpnrfsgsgsgtsyslaintmetedaatyycqqwsstpltfgsgtkleikrggggsggggsggggsqvqlkeagpg lvqptqtlsltctvsgfsltsdgvhwirqppgkglewmgiiyydggtdynsaiksrlsisrdtsksqvflkinslqtddtamyyca rihfdywgqgvmvtvssdhvcsrdftpptvkilqsscdggghfpptiqllclvsgytpgtinitwledgqvmdvdlstasttqe gelastqseltlsqkhwlsdrtytcqvtyqghtfedstkkcadsnprgvsaylsrpspfdlfirksptitclvvdlapskgtvnltws rasgkpvnhstrkeekqrngtltvtstlpvgtrdwiegetyqcrvthphlpralmrsttktsgpraapevyafatpewpgsrdkrt lacliqnfmpedisvqwlhnevqlpdarhsttqprktkgsgffvfsrlevtraeweqkdeficravhceaspsqtvqravsvnp gkadpsklpswaitlisvngifviccltycfaprcrerrrnerlrresvrpv NT
5B9-IgAH IgA-T4-CD80
(SEQ ID NO: 626)
aagcttgccgccatgaggttctctgctcagcttctggggctgcttgtgctctggatccctggatccactgcaga tattgtgatgacgcaggctgcattctccaatccagtcactcttggaacatcagcttccatctcctgcaggtctagtaagagtctcctaca tagtaatggcatcacttatttgtattggtatctgcagaagccaggccagtctcctcagctcctgatttatcagatgtccaaccttgcctca ggagtcccagacaggttcagtagcagtgggtcaggaactgatttcacactgagaatcagcagagtggaggctgaggatgtgggtg tttattactgtgctcaaaatctagaacttccgctcacgttcggtgctgggaccaagctggagctgaaacggggtggcggtggctcgg gcggtggtgggtcgggtggcggcggatcgtcacaggtgcagctgaagcagtcaggacctggcctagtgcagtcctcacagagc ctgtccatcacctgcacagtctctggtttctcattaactacctatgctgtacactgggttcgccagtctccaggaaagggtctggagtg gctgggagtgatatggagtggtggaatcacagactataatgcagctttcatatccagactgagcatcaccaaggacgattccaaga gccaagttttctttaaaatgaacagtctgcaacctaatgacacagccatttattactgtgccagaaatgggggtgataactacccttatt actatgctatggactactggggtcaaggaacctcagtcaccgtctcctctgatcagccagttccctcaactccacctaccccatctcc ctcaactccacctaccccatctccctcatgctgccacccccgactgtcactgcaccgaccggccctcgaggacctgctcttaggttc agaagcgatcctcacgtgcacactgaccggcctgagagatgcctcaggtgtcaccttcacctggacgccctcaagtgggaagag cgctgttcaaggaccacctgaccgtgacctctgtggctgctacagcgtgtccagtgtcctgccgggctgtgccgagccatggaacc atgggaagaccttcacttgcactgctgcctaccccgagtccaagaccccgctaaccgccaccctctcaaaatccggaaacacattc cggcccgaggtccacctgctgccgccgccgtcggaggagctggccctgaacgagctggtgacgctgacgtgcctggcacgtgg cttcagccccaaggatgtgctggttcgctggctgcaggggtcacaggagctgccccgcgagaagtacctgacttgggcatcccgg caggagcccagccagggcaccaccaccttcgctgtgaccagcatactgcgcgtggcagccgaggactggaagaagggggaca ccttctcctgcatggtgggccacgaggccctgccgctggccttcacacagaagaccatcgaccgcttggcgggtaaacccaccca tgtcaatgtgtctgttgtcatggcggaggtggacgcggatccttcgaacaacctgctcccatcctgggccattaccttaatctcagtaa atggaatttttgtgatatgctgcctgacctactgctttgccccaagatgcagagagagaaggaggaatgagagattgagaagggaa agtgtacgccctgtataaatcgatac -continued AA
5B9-IgAH IgA-T4-CD80
(SEQ ID NO: 627)
mrfsaqllgllvlwipgstadivmtqaafsnpvtlgtsasiscrssksllhsngitylywylqkpgqsfpqlli yqmsnlasgvpdrfsssgsgtdftlrisrveaedvgvyycaqnlelpltfgagtklelkrggggsggggsggggssqvqlkqsg pglvqssqslsitctvsgfslttyavhwvrqspgkglewlgviwsggttdynaafisrisitkddsksqvffkmnslqpndtaiy ycarnggdnypyyyamdywgqgtsvtvssdqpvpstpptpspstpptpspscchprlslhrpaledlllgseailtctltglrda sgvtftwtpssgksavqgppdrdlcgcysvssvlpgcaepwnhgktftctaaypesktpltatlsksgntfrpevhllpppseel alnelvtltclargfspkdvlvrwlqgsqelprekyltwasrqepsqgtttfavtsilrvaecdwkkgdtfscmvghealplaftqk tidrlagkpthvnvsvvmaevdadpsnnllpswaitlisvngifvviccltycfaprcrerrrnerlrresvrpv NT
5B9-scFv-human IgE Fc (CH2-CH3-CH4)-CD80
(SEQ ID NO: 628)
aagcttgccgccatgaggttctctgctcagcttctggggctgcttgtgctctggatccctggatccactgcaga tattgtgatgacgcaggctgcattctccaatccagtcactcttggaacatcagcttccatctcctgcaggtctagtaagagtctccctaca tagtaatggcatcacttatttgtattggtatctgcagaagccaggccagtctcctcagctcctgatttatcagatgtccaaccttgcctca ggagtcccagacaggttcagtagcagtgggtcaggaactgatttcacactgagaatcagcagagtggaggctgaggatgtgggtg tttattactgtgctcaaaatctagaacttccgctcacgttcggtgctgggaccaagctggagctgaaacggggtggcggtggctcgg gcggtggtgggtcgggtggcggcggatcgtcacaggtgcagctgaagcagtcaggacctggcctagtgcagtcctcacagagc ctgtccatcacctgcacagtctctggtttctcattaactacctatgctgtacactgggttcgccagtctccaggaaagggtctggagtg gctgggagtgatatggagtggrggaatcacagactataatgcagctttcatatccagactgagcatcaccaaggacgattccaaga gccaagttttctttaaaatgaacagtctgcaacctaatgacacagccatttattactgtgccagaaatgggggtgataactacccttatt actatgctatggactactggggtcaaggaacctcagtcaccgtctcctctgatcacgtctgctccagggacttcaccccgcccaccg tgaagatcttacagtcgtcctgcgacggcggcgggcacttcccccgaccatccagctcctgtgcctcgtctctgggtacacccca gggactatcaacatcacctggctggaggacgggcaggtcatggacgtggacttgtccaccgcctctaccacgcaggagggtgag ctggcctccacacaaagcgagctcaccctcagccagaagcactggctgtcagaccgcacctacacctgccaggtcacctatcaag gtcacacctttgaggacagcaccaagaagtgtgcagattccaacccgagaggggtgagcgcctacctaagccggcccagcccgt tcgacctgttcatccgcaagtcgcccacgatcacctgtctggtggtggacctggcacccagcaaggggaccgtgaacctgacctg gtcccgggccagtgggaagcctgtgaaccactccaccagaaaggaggagaagcagcgcaatggcacgttaaccgtcacgtcca ccctgccggtgggcacccgagactggatcgagggggagacctaccagtgcagggtgacccaccccccacctgcccagggccct catgcggtccacgaccaagaccagcggcccgcgtgctgccccggaagtctatgcgtttgcgacgccggagtggccggggagcc gggacaagcgcaccctcgcctgcctgatccagaacttcatgcctgaggacatctcggtgcagtggctgcacaacgaggtgcagct cccggacgcccggcacagcacgacgcagccccgcaagaccaagggctccggcttcttcgtcttcagccgcctggaggtgacca gggccgaatgggagcagaaagatgagttcatctgccgtgcagtccatgaggcagcgagcccctcacagaccgtccagcgagcg gtgtctgtaaatcccggtaaagcggatccttcgaagctcccatcctgggccattaccttaatctcagtaaatggaatttttgtgatatgct gcctgacctactgctttgccccaagatgcagagagagaaggaggaatgagagattgagaagggaaagtgtacgccctgtataaat cgata AA
5B9-scFv-human IgE Fc (CH2-CH3-CH4)-CD80
(SEQ ID NO: 629)
mrfsaqllgllvlwipgstadivmtqaafsnpvtlgtsasiscrssksllhsngitylywylqkpgqspqlli yqmsnlasgvpdrfsssgsgtdftlrisrveaedvgvyycaqnlelpltfgagtklelkrggggsggggsggggssqvqlkqsg pglvqssqslsitctvsgfslttyavhwvrqspgkglewlgviwsggitdynaafisrlsitkddsksqvffkmnslqpndtaiy ycarnggdnypyyyamdywgqgtsvtvssdhvcsrdftpptvkilqsscdggghfpptiqllclvsgytpgtinitwledgqv mdvdlstasttqegelastqseltlsqkhwlsdrtytcqvtyqghtfedstkkcadsnprgvsaylsrpspfdlfirksptitclvvd lapskgtvnltwsrasgkpvnhstrkeekqrngtltvtstlpvgtrdwiegetyqcrvthphlpralmrsttktsgpraapevyaf atpewpgsrdkrtlacliqnfmpedisvqwlhnevqlpdarhsttqprktkgsgffvfsrlevtraeweqkdeficravheaasp sqtvqravsvnpgkadpsklpswaitlisvngifviccltycfaprcrerrrnerlrresvrpv NT
2e12-scFv-IgAH IgA-T4-CD80
(SEQ ID NO: 630)
aagcttatggattttcaagtgcagattttcagcttcctgctaatcagtgcttcagtcataatgtccagaggagtcg acattgtgctcacccaatctccagcttctttggctgtgtctctaggtcagagagccaccatctcctgcagagccagtgaaagtgttgaa tattatgtcacaagtttaatgcagtggtaccaacagaaaccaggacagccacccaaactcctcatctctgctgcatccaacgtagaat ctggggtccctgccaggtttagtggcagtgggtctgggacagacttcagcctcaacatccatcctgtggaggaggatgatattgcaa tgtatttctgtcagcaaagtaggaaggttccttggacgttcggtggaggcaccaagctggaaatcaaacggggtggcggtggctcg ggcggaggtgggtcgggtggcggcggatctcaggtgcagctgaaggagtcaggacctggcctggtggcgccctcacagagcc tgtccatcacatgcaccgtctcagggttctcattaaccggctatggtgtaaactgggttcgccagcctccaggaaagggtctggagt ggctgggaatgatatgggtgatggaagcacagactataattcagctctcaaatccagactgagcatcaccaaggacaactccaa gagccaagttttcttaaaaatgaacagtctgcaaactgatgacacagccagatactactgtgccagagatggttatagtaactttcatt actatgttatggactactggggtcaaggaacctcagtcaccgtctcctcagatcagccagttccctcaactccacctaccccatctcc ctcaactccacctaccccatctccctcatgctgccaccccgactgtcactgcaccgaccggccctcgaggacctgctcttaggttc agaagcgatcctcacgtgcacactgaccggcctgagagatgcctcaggtgtcaccttcacctggacgccctcaagtgggaagag cgctgttcaaggaccacctgaccgtgacctctgtggctgctacagcgtgtccagtgtcctgccgggctgtgccgagccatggaacc atgggaagaccttcacttgcactgctgcctaccccgagtccaagaccccgctaaccgccaccctctcaaaatccggaaacacattc cggcccgaggtccacctgctgccgccgccgtcggaggagctggccctgaacgagctggtgacgctgacgtgcctggcacgtgg cttcagccccaaggatgtgctggttcgctggctgcaggggtcacaggagctgccccgcgagaagtacctgacttgggcatcccgg caggagcccagccagggcaccaccaccttcgctgtgaccagcatactgcgcgtggcagccgaggactggaagaaggggggaca ccttctcctgcatggtgggccacgaggccctgccgctggccttcacacagaagaccatcgaccgcttggcgggtaaacccaccca tgtcaatgtgtctgttgtcatggcggaggtggacgcggatccttcgaacaacctgctcccatcctgggccattaccttaatctcagtaa atggaatttttgtgatatgctgcctgacctactgctttgccccaagatgcagagagagaaggaggaatgagagattgagaagggaa agtgtacgccctgtataaatcgatac AA
2e12-scFv-IgAH IgA-T4-CD80
(SEQ ID NO: 631)
mdfqvqifsfllisasvirnsrgvdivltqspaslavslgqratiscrasesveyyvtslmqwyqqkpgqp pkllisaasnvesgvparfsgsgsgtdfslnihpveeddiamyfcqqsrkvpwtfgggtkleikrggggsggggsggggsqvq lkesgpglvapsqslsitctvsgfsltgygvnwvrqppgkglewlgmiwgdgstdynsalksrlsitkdnsksqvflkmnslqt ddtaryycardgysnfhyyvmdywgqgtsvtvssdqpvpstpptpspstpptpspscchprlshrpaledlllgseailtctltg lrdasgvtftwtpssgksavqgppdrdlcgcysvssvlpgcaepwnhgktftctaaypesktpltatlsksgntfrevhllppps eelalnelvtltclargfspkdvlvrwlqgsqelprekyltwasrqepsqgttffavtsilrvaaedwkkgdtfscmvghealplaf tqktidrlagkpthvnvsvvmaevdadpsnnllpswaitlisvngifviccltycfaprcrerrrnerlrresvrpv NT
2e12-scFv-human IgE Fc (CH2-CH3-CH4)-CD80
(SEQ ID NO: 632)
aagcttatggattttcaagtgcagattttcagcttcctgctaatcagtgcttcagtcataatgtccagaggagtcg acattgtgctcacccaatctccagcttctttggctgtgtctctaggtcagagagccaccatctcctgcagagccagtgaaagtgttgaa tattatgtcacaagtttaatgcagtggtaccaacagaaaccaggacagccacccaaactcctcatctctgctgcatccaacgtagaat ctggggtccctgccaggtttagtggcagtgggtctgggacagacttcagcctcaacatccatcctgtggaggaggatgatattgcaa -continued

```
tgtatttctgtcagcaaagtaggaaggttccttggacgttcggtggaggcaccaagctgaaatcaaacggggtggcggtggctcg ggcggaggtgggtcgggtggcggcggatctcaggtgcagctgaaggagtcaggacctggcctggtggcgccctcacagagcc tgtccatcacatgcaccgtctcagggttctcattaaccggctatggtgtaaactgggttcgccagcctccaggaaagggtctggagt ggctgggaatgatatgggtgatggaagcacagactataattcagctctcaaatccagactgagcatcaccaaggacaactccaa gagccaagttttcttaaaaatgaacagtctgcaaactgatgacacagccagatactactgtgccagagatggttatagtaactttcatt actatgttatggactactggggtcaaggaacctcagtcaccgtctcctcagatcacgtctgctccagggacttcaccccgcccaccg tgaagatcttacagtcgtcctgcgacggcggcgggcacttccccccgaccatccagctcctgtgcctcgtctctgggtacacccca gggactatcaacatcacctggctgaggacgggcaggtcatggacgtggacttgtccaccgcctctaccacgcaggagggtgag ctggcctccacacaaagcgagctcaccctcagccagaagcactggctgtcagaccgcacctacacctgccaggtcacctatcaag gtcacacctttgaggacagcaccaagaagtgtgcagattccaacccgagaggggtgagcgcctacctaagccggcccagcccgt tcgacctgttcatccgcaagtcgcccacgatcacctgtctggtggtggacctggcacccagcaaggggaccgtgaacctgacctg gtcccgggccagtgggaagcctgtgaaccactccaccagaaaggaggagaagcagcgcaatggcacgttaaccgtcacgtcca ccctgccggtgggcacccgagactggatcgaggggagacctaccagtgcagggtgacccacccccacctgcccagggccct catgcggtccacgaccaagaccagcggcccgcgtgctgccccggaagtctatgcgtttgcgacgccggagtggccggggagcc gggacaagcgcaccctcgcctgcctgatccagaacttcatgcctgaggacatctcggtgcagtggctgcacaacgaggtgcagct cccgacgcccggcacagcacgacgcagccccgcaagaccaagggctccggcttcttcgtcttcagccgcctggaggtgacca gggccgaatgggagcagaaagatgagttcatctgccgtgcagtccatgaggcagcgagcccctcacagaccgtccagcgagcg gtgtctgtaaatcccggtaaagcggatccttcgaagctcccatcctgggccattaccttaatctcagtaaatggaattttttgtgatatgct gcctgacctactgctttgccccaagatgcagagagagaaggaggaatgagagattgagaagggaaagtgtacgccctgtataaat cgata
```

AA
2e12-scFv-human IgE Fc (CH2-CH3-CH4)-CD80
(SEQ ID NO: 633)

ccaagttaccgtctcctctgatc

AA
500A2 scFv
(SEQ ID NO: 635)
mlytsqllglllfwisasrsdivltqtpatlslipgervtmtcktsqnigtilhwyhqkpkeapralikyasqsi pgipsrfsgsgsetdftlsinnlepddigiyycqqsrswpvtfgpgtkleikrggggsggggsggggsqvklqqsgselgkpga svklscktsgyiftdhyiswvkqkpgeslqwignvyggnggtsynqkfqgkatltvdkisstaymelssltsedsaiyycarrp vatghamdywgqgiqvtvssd 5' oligo:
Name: hIgAbc15 (SEQ ID NO: 636)
Sequence : GTTGTTGATCAGCCAGTTCCCTCAACTCCACCTACC 3' oligo:
Name: IgA3BB (SEQ ID NO: 637)
GTTGTTTTCGAAGGATCCGCGTCCACCTCCGCCATGACAACAGA 5' oligo:
Name: IgGwT3 (SEQ ID NO: 638)
GTTGTTTTCGAAGGATCCGCTTTACCCGGAGACAGGGAGAGGCT
CTT 3' oligo:
Name: hIgGWT5 (SEQ ID NO: 639)
GTTGTTAGATCTGGAGCCCAAATCTTGTGACAAAACTCACACATG 5' oligo:
Name: FADD5 (SEQ ID NO: 640)
Sequence:
GTTGTGGATCCTTCGAACCCGTTCCTGGTGCTGCTGCACTCGGTGTCG 3' oligo:
Name: FADD3 (SEQ ID NO: 641)
Sequence:
GTTGTTATCGATCTCGAGTTATCAGGACGCTTCGGAGGTAGATGCGTC FADD-CSSCFV
(SEQ ID NO: 642):
Gtggatccttcgaacccgttcctggtgctgctgcactcggtgtcgtccagcctgtcgagcagcgagctgacc gagctcaagttcctatgcctcgggcgcgtgggcaagcgcaagctggagcgcgtgcagagcggcctagacctcttctccatgctgc tggagcagaacgacctggagcccgggcacaccgagctcctgcgcgagctgctcgcctccctgcggcgccacgacctgctgcg gcgcgtcgacgacttcgaggcgggggcggcggccggggccgcgcctgggaagaagacctgtgtgcagcatttaacgtcatat gtgataatgtggggaaagattggagaaggctggctcgtcagctcaaagtctcagacaccaagatcgacagcatcgaggacagata cccccgcaacctgacagagcgtgtgcgggagtcactgagaatctggaagaacacagagaaggagaacgcaacagtggcccac ctggtggggctctcaggtcctgccagatgaacctggtggctgacctggtacaagaggttcagcaggcccgtgacctccagaaca ggagtggggccatgtccccgatgtcatggaactcagacgcatctacctccgaagcgtcctgataactcgagatcgataacaac Peptide sequence
(SEQ ID NO: 643):
vdpsnpflvllhsvssslssseltelkflclgrvgkrklervqsgldlfsmlleqndlepghtellrellaslrrh dllrrvddfeagaaagaapgeedlcaafhvicdnvgkdwrrlarqlkvsdtkidsiedryprnltervreslriwkntekenatva hlvgalrscqmnlvadlvqevqqardlqnrsgamspmswnsdastseas Name: HCD28tm5B (SEQ ID NO: 644)
GTTGTGGATCCTCCCTTTTGGGTGCTGGTGGTGGTTGGTGTCCTG

GCTTGCTATAGCTTG

Name: HCD28tm3S (SEQ ID NO: 645)
GTTGTTTCGAACCCAGAAAATAATAAAGGCCACTGTTACTAGCA

AGCTATAGCAAGCCAG

HCD28tm5'
(SEQ ID NO: 646)
GTTGTGGATCCTCCCTTTTGGGTGCTGGTGGT

-continued

HCD28tm3'
(SEQ ID NO: 647)
GTTGTTTCGAACCCAGAAAATAATAAAGGCCAC

HCD80tm5'
(SEQ ID NO: 648)
GTTGTGGATCCTCCTGCTCCcATCCTGG

HCD80tm3'
(SEQ ID NO: 649)
GTTGTTTCGAACGGCAAAGCAGTAGGTCAGGC

Name: MFADD5BB (SEQ ID NO: 650)
Sequence:
GTTGTGGATCCTTCGAACCcATTCCTGGTGCTGCTGCACTCGCTG Name: MFADD3XC (SEQ ID NO: 651)
Sequence:
GTTGTTATCGATCTCGAGTCAGGGTGTTTCTGAGGAAGACAC Murine FADD Nucleotide Sequence (full length, but without flanking -Ig
or transmembrane Sequences)
(SEQ ID NO: 652):
Gtggatccttcgaacatggacccattcctggtgctgctgcactcgctgtccggcagcctgtcgggcaacgat ctgatggagctcaagttcttgtgccgcgagcgcgtgagcaaacgaaagctggagcgcgtgcagagtggcctggacctgttcacg gtgctgctggagcagaacgacctggagcgcgggcacaccgggctgctgcgcgagttgctggcctcgctgcgccgacacgatct actgcagcgcctggacgacttcgaggcggggacggcgaccgctgcgcccccggggaggcagatctgcaggtggcatttgac attgtgtgtgacaatgtggggagagactggaaaagactggcccgcgagctgaaggtgtctgaggccaagatggatgggattgag gagaagtaccccgaagtctgagtgagcgggtaagggagagtctgaaagtctggaagaatgctgagaagaagaacgcctcggt ggccggactggtcaaggcgctgcggacctgcaggctgaatctggtggctgacctggtggaagaagcccaggaatctgtgagca agagtgagaatatgtccccagtactaagggattcaactgtgtcttcctcagaaacaccctgactcgagatcgat Murine FADD
(SEQ ID NO: 653)
vdpsnmdpflvllhslsgslsgndlmelkflcrervskrklervqsgldlftvlleqndlerghtgllrellasl rrhdllqrlddfeagtataappgeadlqvafdivcdnvgrdwkrlarelkvseakmdgieekyprslservreslkvwknaekk nasvaglvkalrtcrlnlvadlveeaqesvsksenmspvlrdstvsssetp Name: MCASP3-5 (SEQ ID NO: 654)
Sequence:
GTTGTGGATCCTTCGAACATGGAGAACAACAAAACCTCAGTGGATTCA Name: MCASP3-3 (SEQ ID NO: 655)
Sequence:
GTTGTTATCGATCTCGAGCTAGTGATAAAAGTACAGTTCTTTCGT Name: mcasp8-5 (SEQ ID NO: 656)
Sequence:
GTTGTTTCGAACATGGATTTCCAGAGTTGTCTTTATGCTATTGCTG Name: mcasp8-3 (SEQ ID NO: 657)
Sequence:
GTTGTTATCGATCTCGAGTCATTAGGGAGGGAAGAAGAGCTTCTTCCG Name: hcasp3-5 (SEQ ID NO: 658)
Sequence:
GTTGTGGATCCTTCGAACATGGAGAACACTGAAAACTCAGTGGAT Name: hcasp3-3 (SEQ ID NO: 659)
Sequence:
GTTGTTATCGATCTCGAGTTAGTGATAAAAATAGAGTTCTTTTGTGAG Name: hcasp8-5 (SEQ ID NO: 660)
Sequence:
GTTGTGGATCCTTCGAACATGGACTTCAGCAGAAATCTTTATGAT Name: hcasp8-3 (SEQ ID NO: 661)
Sequence:
GTTGTTATCGATGCATGCTCAATCAGAAGGGAAGACAAGTTTTTTTCT HuIgGMHWC -continued (SEQ ID NO: 662)
gtt gtt gat cag gag ccc aaa tct tct gac aaa act cac aca tct cca ccg tcc cca gca cct gaa ctc ctg ggt gga ccg tca gtc ttc c NT
2H7-human IgE (CH2-CH3-CH4)
(SEQ ID NO: 663)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaaggtggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctctgatcacgtctgctccaggacttcacccgcccaccgtgaagatcttaca gtcgtcctgcgacggcggcgggcacttccccccgaccatccagctcctgtgcctcgtctctgggtacaccccagggactatcaac atcacctggctggaggacgggcaggtcatggacgtggacttgtccaccgcctctaccacgcaggagggtgagctggcctccaca caaagcgagctcaccctcagccagaagcactggctgtcagaccgcacctacacctgccaggtcacctatcaaggtcacacctttg aggacagcaccaagaagtgtgcagattccaacccgagaggggtgagcgcctacctaagccggcccagcccgttcgacctgttca tccgcaagtcgcccacgatcacctgtctggtggtggacctggcacccagcaaggggaccgtgaacctgacctggtcccgggcca gtgggaagcctgtgaaccactccaccagaaaggaggagaagcagcgcaatggcacgttaaccgtcacgtccaccctgccggtg ggcacccgagactggatcgaggggggagacctaccagtgcagggtgacccaccccccacctgcccagggccctcatgcggtcca cgaccaagaccagcggcccgcgtgctgccccggaagtctatgcgtttgcgacgccggagtggccggggagccgggacaagcg caccctcgcctgcctgatccagaacttcatgcctgaggacatctcggtgcagtggctgcacaacgaggtgcagctcccggacgcc cggcacagcacgacgcagccccgcaagaccaagggctccggcttcttcgtcttcagccgcctggag~gaccagggccgaatg ggagcagaaagatgagttcatctgccgtgcagtccatgaggcagcgagcccctcacagaccgtccagcgagcggtgtctgtaaat cccggtaaatgataatctaga AA
2H7 scFv IgE (CH2-CH3-CH4)
(SEQ ID NO: 664)
mdfqvqifsfllisasviiargqivlsqspailsaspgekvtmtcrasssvsymhwyqqkpgsspkpwiy apsnlasgvparfsgsgsgtsysltisrveaedaatyycqqwsfnpptfgagtklelkggggsggggsggggssqaylqqsgae lvrpgasvkmsckasgytftsynmhwvkqtprqglewigaiypgngdtsynqkfkgkatltvdkssstaymqlssltsedsa vyfcarvvyysnsywyfdvwgtgttvtvsdhvcsrdftpptvkilqsscdgghfpptiqllclvsgytpgtinitwledgqvm dvdlstasttqegelastqseltlsqkhwlsdrtytcqvtyqghtfedstkkcadsnprgvsaylsrpspfdlfirksptitclvvdla pskgtvnltwsrasgkpvnhstrkeekqrngtltvtstlpvgtrdwiegetyqcrvthphlpralmrsttktsgpraapevyafat pewpgsrdkrtlacliqnfmpedisvqwlhnevqlpdarhsttqprktkgsgffvfsrlevtraeweqkdeficravhcaasps qtvqravsvnpgk NT
2H7 scFv MH (SSS) MCH2WTCH3
(SEQ ID NO: 665)
aagcttgccgccatggattttcaagtgcagattttcagcttcctgctaatcagtgcttcagtcataattgccagag gacaaattgttctctcccagtctccagcaatcctgtctgcatctccaggggagaaggtcacaatgacttgcagggccagctcaagtg taagttacatgcactggtaccagcagaagccaggatcctcccccaaaccctggatttatgccccatccaacctggcttctggagtcc -continued ctgctcgcttcagtggcagtgggtctgggacctcttactctctcacaatcagcagagtggaggctgaagatgctgccacttattactg ccagcagtggagttttaacccacccacgttcggtgctgggaccaagctggagctgaaagatggcggtggctcgggcggtggtgg atctggaggaggtgggagctctcaggcttatctacagcagtctggggctgagctggtgaggcctggggcctcagtgaagatgtcct gcaaggcttctggctacacatttaccagttacaatatgcactgggtaaagcagacacctagacagggcctggaatggattggagct atttatccaggaaatggtgatacttcctacaatcagaagttcaagggcaaggccacactgactgtagacaaatcctccagcacagcc tacatgcagctcagcagcctgacatctgaagactctgcggtctatttctgtgcaagagtggtgtactatagtaactcttactggtacttc gatgtctggggcacagggaccacggtcaccgtctcttctgatcaggagcccaaatcttctgacaaaactcacacatcccaccgtc cccagcacctgaactcctggggggatcgtcagtcttcctcttccccccaaaacccaaggacaccctcatgatctcccggacccctg aggtcacatgcgtggtggtggacgtgagccacgaagaccctgaggtcaagttcaactggtacgtggacggcgtggaggtgcata atgccaagacaaagccgcgggaggagcagtacaacagcacgtaccgtgtggtcagcgtcctcaccgtcctgcaccaggactgg ctgaatggcaaggagtacaagtgcaaggtctccaacaaagccctcccagcccccatcgagaaaacaatctccaaagccaaggg cagccccgagaaccacaggtgtacaccctgcccccatcccgggatgagctgaccaagaaccaggtcagcctgacctgcctggtc aaaggcttctatcccagcgacatcgccgtggagtgggagagcaatgggcagccggagaacaactacaagaccacgcctcccgt gctggactccgacggctccttcttcctctacagcaagctcaccgtggacaagagcaggtggcagcaggggaacgtcttctcatgct ccgtgatgcatgaggctctgcacaaccactacacgcagaagagcctctccctgtctccgggtaaatgatctaga AA
2H7 scFv MH (SSS) MCH2WTCH3
(SEQ ID NO: 666)
mdfqvqifsfllisasviiargqivlsqspailsaspgekvtmtcrasssvsymhwyqqkpgsspkpwiy apsnlasgvparfsgsgsgtsyshisrveaedaatyycqqesfnpptfgagtklelkdgggsggggsggggssqaylqqsgae lvrpgasvkmsckasgytftsynmhwvkqtprqglewigaiypgngdtsynqkfkgkatltvdksssstaymqlssltsedsa vyfcarvvyysnsywyfdvwgtgttvtvssdqepkssdkthtsppspapellggssvflfppkpkdtlmisrtpevtcvvvdv shedpevkfnwyvdgvevhnaktkpreeqynstyrvvsvltvlhqdwlngkeykckvsnkalpapiektiskakgqprep qvytlppsrdeltknqvsltclvkgfypsdiavewesngqpennykttppvldsdgsfflyskltvdksrwqqgnvfscsvmh ealhnhytqkslslspgk NT
5B9 scFv MTHWTCH2CH3
(SEQ ID NO: 667)
aagcttgccgccatgaggttctctgctcagcttctggggctgcttgtgctctggatccctggatccactgcaga tattgtgatgacgcaggctgcattctccaatccagtcactcttggaacatcagcttccatctcctgcaggtctagtaagagtctcctaca tagtaatggcatcacttatttgtattggtatctgcagaagccaggccagtctcctcagcctgatttatcagatgtccaaccttgcctca ggagtcccagacaggttcagtagcagtgggtcaggaactgatttcactgagaatcagcagagtggaggctgaggatgccta tttattactgtgctcaaaatctagaacttccgctcacgttcggtgctgggaccaagctggagctgaaacggggtggcggtggctcgg gcggtggtgggtcgggtggcggcggatcgtcacaggtgcagctgaagcagtcaggacctggcctagtgcagtcctcacagagc ctgtccatcacctgcacagtctctggtttctcattaactacctatgctgtacactgggttcgccagtctccaggaaagggtctggagtg gctgggagtgatatggagtggtggaatcacagactataatgcagctttcatatccagactgagcatcaccaaggacgattccaaga gccaagttttctttaaaatgaacagtctgcaacctaatgacacagccatttattactgtgccagaaatgggggtgataactacccttatt actatgctatggactactggggtcaaggaacctcagtcaccgtctcctctgatcaggagcccaaatcttctgacaaaactcacacatc -continued

```
cccaccgtcccagcacctgaactcctggggggaccgtcagtcttcctcttcccccaaaacccaaggacaccctcatgatctccc ggacccctgaggtcacatgcgtggtggtggacgtgagccacgaagaccctgaggtcaagttcaactggtacgtggacggcgtgg aggtgcataatgccaagacaaagccgcgggaggagcagtacaacagcacgtaccgtgtggtcagcgtcctcaccgtcctgcacc aggactggctgaatggcaaggagtacaagtgcaaggtctccaacaaagcctcccagcccccatcgagaaaacaatctccaaag ccaaagggcagccccgagaaccacaggtgtacaccctgcccccatcccgggatgagctgaccaagaaccaggtcagcctgacc tgcctggtcaaaggcttctatcccagcgacatcgccgtggagtgggagagcaatgggcagccggagaacaactacaagaccac gcctcccgtgctggactccgacggctccttcttcctctacagcaagctcaccgtggacaagagcaggtggcagcaggggaacgtc ttctcatgctccgtgatgcatgaggctctgcacaaccactacacgcagaagagcctctccctgtctccgggtaaatgatctaga
```

AA
5B9 scFv MTHWTCH2CH3
(SEQ ID NO: 668)
mrfsaqllgllvlwipgstadivmtqaafsnpvtlgtsasiscrsskslllhsngitylywylqkpgqspqlli yqmsnlasgvpdrfsssgsgtdftlrisrveaedvgvyycaqnlelpltfgagtklelkggggsggggsggggssqvqlkqsg pglvqssqslsitctvsgfslttyavhwvrqspgkglewlgviwsggitdynaafisrlsitkddsksqvffkmnslqpndtaiy ycarnggdnypyyyamdywgqgtsvtvssdqepkssdkthtsppspapellggpsvflfppkpkdtlmisrtpevtcvvvd vshedpevkfnwyvdgvevhnaktkpreeqynstyrvvsvltvlhqdwlngkeykckvsnkalpapiektiskakgqpre pqvytlppsrdeltknqvsltclvkgfypsdiavewesngqpennyktppvldsdgsfflyskltvdksrwqqgnvfscsvm healhnhytqkslslspgk From the foregoing, it will be appreciated that, although specific embodiments of the invention have been described herein for the purpose of illustration, various modifications may be made without deviating from the spirit and scope of the invention. Accordingly, the present invention is not limited except as by the appended claims.

SEQUENCE LISTING (668 sequences)

SEQ ID NO: 1 - DNA, 812 bp, Artificial sequence
  2H7 scFv
  sig_peptide (13)..(78)
  V_region (79)..(396): light chain variable region for anti-CD20 scFv
  misc_feature (397)..(444): asp-gly3ser(gly4ser) 2-ser peptide linker
  V_region (445)..(808): heavy chain variable region for anti-CD20 scFv
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatca

SEQ ID NO: 2 - DNA, 1518 bp, Artificial sequence
  2H7 scFv WTHWTCH2CH3
  misc_feature (13)..(807): Murine anti-human CD20 scFv
  C_region (808)..(1513): Human IgG1 Fc tail, wild type hinge, CH2 and CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 3 - DNA, 1518 bp, Artificial sequence
  2H7scFvMTH(SSS)MTCH2WCH3
  misc_feature (13)..(807): Mouse anti-human CD20 scFv
  C_region (808)..(1513): Hinge cysteines (826-829; 844-847; 853-856) mutated to serines proline to serine mutation (880-883) in Ch2 disrupts effector function
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcaggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 4 - DNA, 1518 bp, Artificial sequence
  2H7 scFv MTH(SSS)WTCH2CH3
  misc_feature (13)..(807): Mouse anti-human CD20 scFv
  C_region (808)..(1513): Hinge cysteines mutated to serines (826-829; 844-847; 853-856) wild type CD2 and CD3 domains mediate effector functions
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 5 - DNA, 1524 bp, Artificial sequence
  2H7 IgAHWTHG1C
  misc_feature (1)..(796): Mouse anti-human CD20 scFv
  N_region (797)..(864): Human IGA hinge region
  C_region (865)..(1518): Human IgG1 CH2 and CH3 wild type Fc domain
atggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcagccagttccctcaactccacctaccccatctccctcaactccacctaccccatctccctcatgcgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 6 - DNA, 711 bp, Artificial sequence
  hUMAN IgG1 Fc (SSS hinge)
  misc_feature (1)..(705): Hinge cysteines mutated to serines (19-21; 37-39; 46-48)
gatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 7 - DNA, 729 bp, Artificial sequence
  Human IgA-derived hinge chimera with human IgG1 CH2
  N_region (1)..(69): Human IGA hinge
  C_region (70)..(723): Human wild type IgG1 CH2 and CH3, Fc
gatcagccagttccctcaactccacctaccccatctccctcaactccacctaccccatctccctcatgcgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 8 - DNA, 825 bp, Artificial sequence
  HD37 scFv
  misc_feature (13)..(72): Light chain leader peptide
  V_region (73)..(405): Light chain variable domain for mouse anti-human CD19; HD37
  misc_feature (406)..(450): Synthetic (Gly4Ser) 3 linker peptide
  V_region (454)..(825): Heavy chain variable domain for mouse anti-human CD-19: HD37
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcggatcgtcacaggttcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctca

SEQ ID NO: 9 - DNA, 795 bp, Artificial sequence
  G28-1 scFv
  misc_feature (13)..(72): Light chain leader peptide sequence
  V_region (73)..(393): Light chain variable domain for mouse anti-human CD37: G28-1
  misc_feature (394)..(441): Synthetic linker peptide encoded (Gly4Ser) 3
  V_region (442)..(795): Heavy chain variable domain for mouse anti-human CD37: G28-1
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagctggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcag

SEQ ID NO: 10 - DNA, 824 bp, Artificial sequence
  G28-7
  sig_peptide (1)..(61): Native light chain leader peptide
  V_region (62)..(397): Light chain variable domain for mouse anti-human CD22: G28-7
  misc_feature (398)..(445): (Gly4Ser) 3 linker peptide
  V_region (445)..(818): Heavy chain variable domain for mouse anti-human CD22: G28-7
  misc_feature (819)..(824): BcII restriction site
atggagtcacattcccaggtctttctctccctgctgctctgggtatctggtacctgtgggaacattatgatgacacagtcgccatcatctctggctgtgtcagcaggagaaaaggtcactatgaactgtaagtccagtcaaagtgttttctacagttcaaatcagaggaattatttggcctggtatcagcagaaaccagggcagtctcccaaattgctgatctactgggcatctactagggaatctggtgtccctgatcgcttcacaggcagtggatccgggacagactttactcttaccatcagcagtgtacatactgaagacctggcagtttattactgtcatcaattcctctcttcgtggacgttcggtggaggcaccaagctggaaatcaaaggcggtggtggttcgggtggtggtggttcgggtggcggcggatcttctcaggtccaactgcagcagcctggggctgaactggtgaagcctgggacttcagtgaagctgtcctgcaaggcctctggctacaccttcaccaactactggatggtctgggtgaagcagacgcctggagaaggccttgagtggattggagaaattattcctagcaacggtcgtactaaatacaatgagaagttcaagagcaaggccacactgactgcagacaaatcctcccgcacagcctacatgcaactcagcagcctggcatctgaggactctgcggtctattattgtgcaagagagatgtccattattactacggtactgactcccggtttgcttactggggccaagggactctggtcactgtctctgcagcctgatca

SEQ ID NO: 11 - protein, 266 aa, Mus musculus
  2H7 scFv
  INIT_MET (1)..(1)
  SIGNAL (1)..(22)
  DOMAIN (23)..(128): Light chain variable domain for mouse anti-human CD20
  SITE (129)..(144): Asp=(Gly3Ser)-(Gly4Ser) 2-Ser Linker Peptide
  DOMAIN (145)..(266): Heavy chain variable domain for mouse anti-human CD20
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSD

SEQ ID NO: 12 - protein, 271 aa, Mus musculus
  HD37 scFv
  SITE (1)..(271): Mouse anti-human CD19 scFv
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSS

SEQ ID NO: 13 - protein, 261 aa, Mus musculus
  G28-1 scFv
  SITE (1)..(259): Mouse anti-human CD37 scFv
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPELEKPGASVKISCKASGYSFTGYNMNWVKQNNGKSERLEWIGNIDPYYGGTTYNRKFKGKATLTVDKSSSTAYMQLKSLTSEDSAVYYCARSVGPMDYWGQGTSVTVSS

SEQ ID NO: 14 - protein, 272 aa, Mus musculus
  G28-7 scFv
  SITE (1)..(272): Mouse anti-human CD22 scFv
MESHSQVFLSLLLWVSGTCGNIMMTQSPSSLAVSAGEKVTMNCKSSQSVFYSSNQRNYLAWYQQKPGQSPKLLIYWASTRESGVPDRFTGSGSGTDFTLTISSVHTEDLAVYYCHQFLSSWTFGGGTKLEIKGGGGSGGGGSGGGGSSQVQLQQPGAELVKPGTSVKLSCKASGYTFTNYWMVWVKQTPGEGLEWIGEIIPSNGRTKYNEKFKSKATLTADKSSRTAYMQLSSLASEDSAVYYCAREMSIITTVLTPGLLTGAKGLWSLSLQ

SEQ ID NO: 15 - protein, 499 aa, Artificial sequence
  2H7 scFv-hIgG1 WTHWTCH2CH3
  SITE (1)..(265): Mouse anti-human CD20 scFv: 2H7
  DOMAIN (266)..(499): Human IgG1 wild type hinge, CH2, CH3, Fc
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 499 aa, Artificial sequence
  MHMG1C
  SITE (1)..(265): 2H7 scFv targeted to human CD20
  DOMAIN (265)..(499): Hinge cysteines mutated to serines (amino acids 272, 278, 281) proline in CH2 mutated to serine (amino acid 290)
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQCWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 499 aa, Artificial sequence
  MHWTG1C
  SITE (1)..(265): Mouse anti-human CD20 scFv: 2H7
  DOMAIN (266)..(499): Hinge cysteines mutated to serines (amino acids  272, 278, 281) CH2 and CH3 domains are wild type in sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 506 aa, Artificial sequence
  IgAHWTHG1C
  SITE (1)..(265): Mouse anti-human CD20 scFv: 2H7
  DOMAIN (266)..(288): Wild type IGA hinge
  DOMAIN (289)..(505): Human IgG1 CH2 and CH3 domains, wild type sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 234 aa, Homo sapiens
  DOMAIN (1)..(234): Mutant IgG1 hinge (amino acids 7, 13, 16) wild type CH2 and CH3 domains alternative carboxy terminus of scFvig fusion proteins
DQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 240 aa, Homo sapiens
  SITE (1)..(23): Alternative carboxy terminus of scFvig fusion proteins
  DOMAIN (24)..(240): Human IgG1 wild type Ch2 and CH3 Fc
DQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - DNA, 1470 bp, Artificial sequence
  2H7scFv-CD154 L2
  misc_feature (1)..(808): Mouse anti-human CD20 scFv
  misc_feature (814)..(1455): Human extracellular domain long form, CD154
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatccaagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactcgagtgataatctaga

SEQ ID NO: 22 - DNA, 1290 bp, Artificial sequence
  2H7scFv-CD154 S4
  misc_feature (13)..(808): Mouse anti-human CD20 scFv
  misc_feature (814)..(1275): Human extracellular domain, short form, CD154
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatccagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactcgagtgataatctaga

SEQ ID NO: 23 - DNA, 43 bp, Artificial sequence
  Oligonucleotide
gtcaagcttgccgccatggattttcaagtgcagatttttcagc

SEQ ID NO: 24 - DNA, 74 bp, Artificial sequence
  Oligonucleotide
gtcgtcgagctcccacctcctccagatccaccaccgcccgagccaccgccacctttcagctccagcttggtccc

SEQ ID NO: 25 - DNA, 37 bp, Artificial sequence
  Oligonucleotide
gctgctgagctctcaggcttatctacagcaagtctgg

SEQ ID NO: 26 - DNA, 32 bp, Artificial sequence
  Oligonucleotide
gttgtctgatcagagacggtgaccgtggtccc

SEQ ID NO: 27 - DNA, 34 bp, Artificial sequence
  Oligonucleotide
gttgtcggatccagaaaacagctttgaaatgcaa

SEQ ID NO: 28 - DNA, 44 bp, Artificial sequence
  Oligonucleotide
gttgtttctagattatcactcgagtttgagtaagccaaaggacg

SEQ ID NO: 29 - DNA, 35 bp, Artificial sequence
  Oligonucleotide
gttgtcggatccaagaaggttggacaagatagaag

SEQ ID NO: 30 - DNA, 23 bp, Artificial sequence
  Oligonucleotide
gtctatataagcagagctctggc

SEQ ID NO: 31 - DNA, 25 bp, Artificial sequence
  Oligonucleotide
cgaggctgatcagcgagctctagca

SEQ ID NO: 32 - DNA, 25 bp, Artificial sequence
  Oligonucleotide
ccgcaatttgaggattctgatcacc

SEQ ID NO: 33 - protein, 483 aa, Artificial sequence
  2H7scFv-CD154 L2
  SITE (1)..(266): Mouse anti-human CD20 scFv
  DOMAIN (268)..(481): Extracellular domain, long form, human CD154
MEDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 34 - protein, 422 aa, Artificial sequence
  2H7scFv-CD154 S4
  SITE (1)..(266): Mouse anti-human scFv
  DOMAIN (268)..(421): Extracellular domain, short form, human CD154
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNRYWYFDVWGTGTTVTVSDPENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 35 - DNA, 63 bp, Homo sapiens
  N_region (1)..(63): Portion of human IGA hinge domain conataining only 1 cysteine
ccagttccctcaactccacctaccccatctccctcaactccacctaccccatctccctcatgc

SEQ ID NO: 36 - protein, 21 aa, Homo sapiens
PVPSTPPTPSPSTPPTPSPSC

SEQ ID NO: 37 - DNA, 763 bp, Homo sapiens
  misc_feature (1)..(6): Bcli site for fusion to amin terminal scFvs
  N_region (8)..(752): Wild t ype IGA hinge, CH2, CH3 domains truncated to remove secretory component attachment
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 38 - protein, 250 aa, Homo sapiens
  DOMAIN (3)..(250): Truncated form, removal of last three amino acids that mediate attachment to secretory component
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKWLTWASRQEPSQGTTTFAVTSILRVAAEDWKKGDTFSCMVGHEALPLAFTQKTIDRLAGKPTHVNVSVVMAEVD

SEQ ID NO: 39 - protein, 5 aa, Artificial sequence
  Linker polypeptide
GGGGS

SEQ ID NO: 40 - protein, 4 aa, Artificial sequence
  Core hinge region of human IgG1
CPPC

SEQ ID NO: 41 - protein, 24 aa, Artificial sequence
  Human IgA-derived hinge
PASPSPTPPTSPSPTPPTSPVPQD

SEQ ID NO: 42 - DNA, 1593 bp, Homo sapiens
ccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaatgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 43 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 44 - DNA, 4473 bp, Homo sapiens
aaggggaggtaaccctggcccctttggtcggggccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggag

SEQ ID NO: 45 - protein, 1255 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRSPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDLDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 46 - DNA, 5484 bp, Homo sapiens
aattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttctttttttttttttttttaaagcagatggttgaaacacccatgctatctgttcctatctgcaggaactgatgtgtgcatatttagcatccctggaaatcataataaagtttccattagaacaaaagaataacattttctataacatatgatagtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctc

SEQ ID NO: 47 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMWLEERRLVHRDLAARNVLVKSPNHVKITDFGLARLLEGDEKEYNADGGKMPIKWMALECIHWRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQLVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 48 - DNA, 1593 bp, Homo sapiens; identical to SEQ ID NO: 42

SEQ ID NO: 49 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEGNCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 50 - DNA, 990 bp, Homo sapiens
cagtgtgctggcggcccggcgcgagccggcccggccccggtcgggcctccgaaaccatgaactttctgctgtcttgggtgcattggagcctcgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacaccgcggccgccagcacactg

SEQ ID NO: 51 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 52 - DNA, 3166 bp, Homo sapiens
aagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagttaccacctcctccccggccggcggcggacagtggacgcggcggcgagccgcgggcaggggccggagcccgcccccggaggcggggtggagggggtcggagctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagcgcgcgcgctccccagccctggcccggcctcgggccgggaggaagagtagctcgccgaggcgccgaggagagcgggccgccccacagcccgagccggagagggacgcgagccgcgcgccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctccaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacacactcgcgttgcaaggcgaggcagcttgagttaaacgaacgtacttgcagatgtgacaagccgaggcggtgagccgggcaggaggaaggagcctccctcagggtttcgggaaccagatctctctccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaagaatgtgcaaggccagggcatgggggcaaatatgacccagttttgggaacaccgacaaacccagccctggcgctgagcctctctaccccaggtcagacggacagaaagacaaatcacaggttccgggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagcgccccttcctgggactcgccctcatcctcttcctgctccccttcctggggtgcagcctaaaaggacctatgtcctcacaccattgaaaccactagttctgtccccccaggaaacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattagaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaagagggtttcaatatacatctacatactatatatatattgggcaacttgtatttgtgtgtatatatatatatatatgtttatgtatatatgtgatcctgaaaaaataaacatcgctattctgttttttatatgttcaaaccaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaa

SEQ ID NO: 53 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCSNDEGLECVPTEESNITMQIMRIKPHQGQHIGEMSFLQHNKCECRPKKDRARQENPCGPCSERRKHLFVQDPQTCKCSCKNTHSRCKARQLELNERTCRCDKPRR

SEQ ID NO: 54 - DNA, 725 bp, Homo sapiens
cttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggtatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaag

SEQ ID NO: 55 - protein, 153 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 56 - DNA, 8837 bp, Homo sapiens
  misc_feature (238)..(239): n = A, T, C or G
  misc_feature (733)..(733): n = A, T, C or G
  misc_feature (3178)..(3203): n = A, T, C or G
  misc_feature (7393)..(7393): n = A, T, C or G
cccaaccccgcgcacagcgggcactggtttcgggcctctctgtctcctacgaagtccgtagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgnngctcccggacactgaggactggccccggggtctcgctcaccttcagcagcgtccaccgcctgccacagagcgttcgatcgctcgctgcctgagctcctggtgcgcccgcggacgcagcctccagcttcgcggtgagctccccgccgcgccgatcccctccgcctctgcgcccctgaccggctctcggcccgcatctgctgctgtcccgccggtgctggcgctcgtccgctgcgccggggaggccggcgtggggcgcgggacacggctgcggacttgcggctgcgctgcgctcgctcctgctgggcgccccgaaatccgcgccactttcgtttgctcattgcaaagatctcatttgtggggaaagcggctggagggtcccaaagtggggcgggcagggggctggggcgagggacgcggaggagaggcgctcccgccgggcggtaaagtgcctctagcccgcgggcctaggactccgccgggagggcgcgcggagngcgaagtgattgatggcggaagcgggggggcaaggggggcaggggggcgcgggattccgccggcgaccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctgatcctctctcctctggcggccggagcctccgtaggctccaagcctggcccagattcggcggcgcagccggccttccgcgcgtccgcacctagcgggggctccggggctccggcgcggcaccggggggcgctcgggatctggctgaggctccaaggcccgcgtggccggctcctcctgctggggcaggtggcggctgcgcgccccgcccgagcccaggggccccctcagccgcaacaaccagcaaggaccccccgactcagccccaagccacctgcatctgcactcagacggggcgcacccgcagtgcagcctcctggtggggcgctgggagcccgcctgcccctgcctgcccggagaccccagctcacgagcacaggccgcccgggcaccccagaaacccgggatggggcccctgaattctctaggacgggcattcagcatggccttggcgctctgcggctccctgccccccacccagcctcgcccccgcgcaccccccagcccctgcgaccgccgcccccccccccggggccccagggccccagcccgcaccccccgccccgctcttggctcgggttgcgggggcgggccgggggcggggcgagggctccgcgggcgcccattggcgcgggcgcgaggccagcggccccgcgcggccctgggccgcggctggcgcgactataagagccgggcgtgggcgcccgcagttcgcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcaccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccaggtaagcggcgtgtgcgggccgggccggggccggggctggggcggcgcgggcttgcggcgacgcccggcccttcctccgcccgctcccggcccggggcctgcggggctcggcggggcggctgagccgggggggaggaggaggaggaggaggaggacggacggctgcgggtcccgttccctgcgcggagcccgcgctaccnnnnnnnnnnnnnnnnnnnnnnnnnngacgtccccgctgaagggggtcggtctgtgggtgcagggggtgccgcctcacatgtgtgattcgtgccttgcgggccctggcctccggggtgctgggtaacgaggaggggcgcggagccgcagaagcccaccctggtgtcgttgacgccggtgccagcgagaccgcgagaggaagacgggggcgggcggggccaggatggagaggggccgagttggcaggagtcatggcagacgccacactcgcgaccatctcccccacacccctctggcctctgtccgcaacatttccaaacaggagtcccgggagagggggagaggggctgctggtctgaggctaagaagggcagagccttcgacccggagagaggccgcggccgcctgccccagtggcaacgttgaagttttccatacaacggaggtcgggaaggagaccccccccccccttcactgccctgtgaagagatgagccgggggtgcaggatgggagcccatggcacttcgctacgggatgtccagggctccggttgggggtgcaggagagaagagactggctgggaggagggagagggcgggagcaaaggcgcgggggtgtggtcagagggagaggggtgggggttaggtggagcccgggctgggaggagtcggctcacacataaaactgaggcactgaccagcctgcaaactggatattagcttctcctgtgaaagagacttccagcttcctcctcctcctcttcctcctcctcctcctgccccagcgagccttctgctgagctgtaggtaaccagggctgtggagtgaaggacccccgctgccatcccactccagcctgaggcagggcagcagggggcacggcccacgcctgggcctcgggccctgcagccgccagcccgctgcctctcggacagcacccccctcccctcttttcctctgcccctgcccccacctggcgtctctgctccctcacctgctccttccctttctgttccttcccttcggccccctccttgcccagctcaggacttttcctgggccctcacctgctccgcaccgctgcatgcttcctgtcctgctttctgccggtcccctgacccggacctccaagcgcagagtggtggggcttgttgcggaagcgcggcgagggctagagtggccagctggcggagtgtgctcttagaatttggaagggggtggcagagggggcggtgagaggactggccagggtccgccatgtcaaggagatgaccaaggaggctttcagatcctcggcgcagtcgcccactagtctttagagagggcatgcaaagttgtgcttctgtcccactgcctgctcagtcgctcacataatttattgcatcaaaaactcccctgggtctgcggagcaaggctggggctgcccgcctggagggtaccaccttctgcaggagcagggccaacttgctgtggtggctcccggcctcccacccccgagtgggtaacccggccctgtgacctgcagcctgtggagggggtgtgcctaagactggcctccccttccagattgtagtctggggaacctggtgtcggacttcccaggtggcctgagctggtctcttcagctccacggggagagtttggtagcgcaaatagggagatgttctgggcccctggccttactggttcgatttgaggcctggaaaggaggctctgggcgtgtgtgtgtgtgtttgggggtacccaaggcagactggagttggagaactgggtgactgggaaaacaaggtttctagagcatgggtggcgtggttgtgttaaccattggagtcgcttgacccaggcctggctcagctgcagactggaaaggtggaaaagccagggggaggggcggggctggcccagcaggactggcctgctgctttgagggcgatggtcctcctggaccccccctgctcagctgggggttgtggggaggaaggggctggtcctccttggagcacatgctctgtaggggtggggctgtctgccatcttggcggcgctggaggcctgagaagtggcgatgtaacgctgggctggccctgcccccatggtgtcataggacggaggcaggtcgggtgtccagcctgggcccctgcagctgtggatgccgctgagctcctgcaataatgaccgtgcagatggtcacccctcgtgtaaaattactagtgcttcttgcaaatggaaggaactgggccttttctgtgtgcttctggacgcttcattctgcacatggccctgcgccctcacctcggcattatgacctgtgtgttacttttgtaataaaaataatgtttataggaaagccgtgctttcaattttcaactgaatttgtaggttggcaaatttggtttgggaggggcacctctggcctggggcttggcctggctgccccgctcacgccacttctctcccgcccccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagtaagtagcagggaggggcttcctcagacctggtcaggcccctagagtgaccggtgaggatctcccatcctcaagccaggggagcacactcctaggtcagcagcccagccgcttgctctgagactttgaccttcccgccgcgtttctgagcacgtgcggtgtcccagggcatccacaccagctgcctttcccatcacacgcctccttcgaagggtgggccagaggtgccccctagacgtcaggggcatctacaggggtctccctgggcatcagaatttctgttgggggccgtgaggctcctgctcctgaggcaccgcacgcctagtgcagggcttcaggctctggaggaagagcctgcctttcttcctgcaccttttggacattttgacaagggacgtgcgttcggtgaatgatcagaattaaaatcaataaagtgatttatataattaaaatcaataagacaagtgcagttggtgggtggcaggggtgagcggtgcatgcgcctccttgggccccaaggctgccgtggggggtgcccacctgctgacctcaaggacgcttcagcctttcctcatgtttctctcttggttctccagcctgggggctggcaggtgggtgcatggcccattgtccttgagaccccacccccagataggggggctgggtggatgcagaggcaggcatggtgcctgggcatgcctgatggggcaggggaggggccgctccttactggcagaggccgcaacttattccacctgacactcaccacgtgacatctttaccaccactgcttactcacgctgtgaaatgggctcacaggatgcaaatgcacttcaaagcttctctctgaaaagttcctgctgcttgactctggaagcccctgcccgccctggcctctcctgtgccctctctcttgcctgccccatttgggggtaggaagtggcactgcagggcctggtgccagccagtccttgcccagggagaagcttccctgcaccaggctttcctgagaggaggggagggccaagcccccacttgggggcccccgtgacggggcctcctgctccctcctccggctgatggcacctgccctttggcaccccaaggtggagcccccagcgaccttccccttccagctgagcattgctgtgggggagagggggaagacgggaggaaagaagggagtggttccatcacgcctcctcagcctcctctcctcccgtcttctcctctcctgcccttgtctccctgtctcagcagctccaggggtggtgtgggcccctccagcctcccaggtggtgccaggccagagtccaagctcacggacagcagtcctcctgtgggggccctgaactgggctcacatcccacacattttccaaaccactcccattgtgagcctttggtcctggtggtgtccctctggttgtgggaccaagagcttgtgcccatttttcatctgaggaaggaggcagcagaagtcacgggctggtctgggccccactcacctcccctctcacctctcttcttcctgggacgcctctgcctgccggctctcacttccctcccctgacccgcagggtggctgcgnccttccagggcctggcctgagggcaggggtggtttgctgggggttcggcctccgggggctgggggtcggtgcggtgctaacacggctctctctgtgctgtgggacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggtgagggtcctgggcccctttcccactctctagagacagagaaatagggcttcgggcgcccagcgtttcctgtggcctctgggacctcttggccagggacaaggacccgtgacttccttgcttgctgtgtggcccgggagcagctcagacgctggctccttctgtccctctgcccgtggacattagctcaagtcactgatcagtcacaggggtggcctgtcaggtcaggcgggcggctcaggcggaagagcgtggagagcaggcacctgctgaccagccccttcccctcccaggacaacttccccgagatacccctgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtcccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaagggccccagaaatcacaggtgggcacgtcgcgtctaccgccatctcccttctcacgggaattttcagggtaaact

SEQ ID NO: 57 - protein, 180 aa, Homo sapiens [sequence omitted]

SEQ ID NO: 58 - DNA, 5010 bp, Homo sapiens
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagcagcatacatttataatgtttgctattgacaagtcattttaatttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcatataaacgtgtagtacagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagtagggccttttggaggtaaaggtata

SEQ ID NO: 59 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 60 - DNA, 6450 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgcctttgggggtgccctgggatccctggggtagtccagctcttattcatttcccagcgtggccctggttggaagaagcagctgtcaagttgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccaaggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaataaagtcatacagtagctcaaaaggcaaccataattctctttggtgcaagtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcatttttttgcatccaattgtgcctgaacttttaaaatatgtaaatgctgccatgttccaaacccatcgtcagtgtgtgtgtttagagctgtgcaccctagaaacaacatacttgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 61 - protein, 595 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 62 - DNA, 5003 bp, Homo sapiens
ggatccattttataagctcaaagataattacttttcagactaagaatatttagggtaaaaagtactgttcaacatctctactgaggatgttatgatgtagcacactctataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgcgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatcctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatagctctgagtccgaggagtctgcgggtccgcttctgaagggcaaacctcgggctctgggtggcgcggcggctggaggaggagccgcggcttgtccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggacttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccattgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacatgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacagcttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggcatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatacaaatagtattgtgggttttgtaggtttttaaaataaccttttttggggagagaattgtcctctaatgaggtattgcgagtggc

SEQ ID NO: 63 - protein, 933 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDSSESEESAGPLLKGKPRALGGAAAGGGAAACPPGAAAGGVALVPKEDSRFSAPRVALVEQDAPMAPGRSPLATTVMDFIHVPILPLNHALLAARTRQLLEDESYDGGAGAASAFAPPRTSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPLGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILAEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 64 - DNA, 2393 bp, Homo sapiens
cgctgagatctgtggaggtttttctctgcaaatgcagaaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcacccctgaggccttccagaaccttcccaaccttcaatatctgttaatatccaacacaggtattaagcaccttccagatgttcacaagattcattctctccaaaaggttttacttgacattcaagataacataaacatccacacaattgaaagaaattctttcgtggggctgagctttgaaagtgtgattctatggctgaataagaatgggattcaagaaatacacaactgtgcattcaatggaacccaactagatgcagtgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtccttgcctttgaagggtatgtcacaaggagctgacagtgcttctacacatttcatctaatttaatattcctggcatacctttaaggtaaattggtcaggaactattaattccatgtgatacattaggaagctgaattattagtaacaacaataataattaaagaatgcaatactgtaaaaaagcggccgcgaatt

SEQ ID NO: 65 - protein, 695 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYITPEAFQNLPNLQYLLISNTGIKHLPDVHKIHSLQKVLLDIQDNINIHTIERNSFVGLSFESVILWLNKNGIQEIHNCAFNGTQLDAVNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLWVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 66 - DNA, 1920 bp, Homo sapiens
aattccctcctggagcccccaccctagctgggggccaggtgggttgggggatgtctcaagagccggtcctttggtcaagcagttctgtgagctggcacttttcctgggaaggtccagagctggccttcagggcaccaaaaaagatgccactcctagatgggccccagctaggtggctgagggggccatgtcctgtgatgctcgcagcgggggaagcaacccgttcggggtgccagcgagcacagcgtctgccctaacccgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgtaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctgcccgggagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacggaattc

SEQ ID NO: 67 - protein, 432 aa, Homo sapiens
MLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 68 - DNA, 3576 bp, Homo sapiens
ctaaaactagcgacctgtccactattatccagcccccttatgtcctctcaacttgtgagaagtggtgttcaaggacccgcagagagaataggaaaagggatcgggggacctagggatggacttcccatgtcttgctgtccagggcctttctgtgtttcctttcctcttcttggcggtcactctgggactaaaaccagagccagggggccccaggtttcctccacatacacacctggggtagtcaaggagcggttggtaaaagtgggaggccagatggagaaaaaacaggttgtcataaggttgagtgattggagcccaagtaccctacacaggaatgactggtggggggaggaggaggaaaagataggggagggggcggagttttgttacctgtcacctgctctgactgtgcctagggcgggagggggactggtataaagcagcaggcaccagccctgttccacctcacacacggagcgccagccttgagtttgttttctagccccttcccgcctgttcaccaccaccatgaccccgggcattcgggctcctttcttcctgctgctacttctagcaagtctaaaaggtgagaggcgcaaggtggggaggggctgcgctgttcaggtgggactcccagtctttctgtggagtttgcttactggtagattatgagagtcataaatggccatccatacaggtatggcccagtatgtgccaggggggaaaagaggctaaggaaggaggctgagaagaggtgacccctcaggagagtgggcactatagtaggcaaataatactctttgtggggagtagagaagagaggctgtgtcaggagaatgagctccggagtggaagaatggggccgtgtgcagtggttccagtctatagttcccacaccctggacgctcaggttcacagagagttcaaggccagcttaggctacagtatgaatacttgtctcaagtagaggaataaatgagccagaagcagaggtgagacctctgcttagggagggaggctgtcaggatgaaggcaaaccaggggctacctgatgctaacatgatcccccttccttccccggttactttgttttcagagtttatatttttcttcttgctctgatttttattcatcaacccagtaggtttttttttttttgttgttgttgttttgttttttttttcttcaactttggctctagccggaactaaaacatcacacatgttatccaaagcgacccagtgtccaactctgttgattagtgctgcgctgctgtgagcataaaaacagtttacccctaatcttccactctggttcaggttttcttgcccttccaagtgaggaaaacagtgtcacctcatctcaggacaccagcagttccttagcatcgactaccactccagtccacagcagcaactcagacccagccaccagacctccaggggactccaccagctctccagtccagagtagcacctcttctccagccaccagagctcctgaagactctaccagtactgcagtcctcagtggcacctcctccccagccaccacagctccagtgaactccgccagctctccagtagcccatggtgacacctcttccccagccactagccctttaaaagactccaacagctctccagtagtccacagtggcacctcttcagctgccaccacagctccagtggattccaccagctctccagtagtccacggtggtacctcgtccccagccaccagccctccaggggactccaccagctctccagaccatagtagcacctcttctccagccaccagagctcccgaagactctaccagtactgcagtcctcagtggcacctcctccccagccaccacagctccagtggactccaccagctctccagtagcccatgatgacacctcttccccagccactagcctttcagaagactccgccagctctccagtagcccacggtggcacctcttctccagccaccagccctctaagggactccaccagttctccagttcacagtagtgcctccatccaaaacatcaagactacatcagacttagctagcactccagaccacaatggcacctcagtcacaactaccagctctgcactgggctcagccaccagtccagaccacagtggtacctcaactacaactaacagctctgaatcagtcttggccaccactccagtttacagtagcatgccattctctactaccaaagtgacgtcaggctcagctatcattccagaccacaatggctcctcggtgctacctaccagttctgtgttgggctcagctaccagtctagtctataatacctctgcaatagctacaactccagtcagcaatggcactcagccttcagtgccaagtcaataccctgtttctcctaccatggccaccacctccagccacagcactattgccagcagctcttactatagcacagtaccattttctaccttctccagtaacagttcaccccagttgtctgttggggtctccttcttcttcttgttcttttacattcaaaaccacccatttaattcttctctggaagaccccagctccaactactaccaagaactgaagaggaacatttctggattggtgggtatcagcctagcctctgccatgtgtcccctgacgtagctcttcaggactgcatggctttcacatcactcctgagtcttctcctcttctcccagtttctgcagatttttaacggagattttctggggatctctagcatcaagttcaggtacgttctggatttgacttgggggaggaatggtcagtctcgtgactttgtggtgtcgggatgggggtggggtggggagaggagtgctgagctataagctcagtctatctgagctccctatttcctgtgaccaggtcaggctccgtggtggtagaatcgactgtggttttccgggagggtacttttagtgcctctgacgtgaagtcacagcttatacagcataagaaggaggcagatagctataatctgactatttcagaagtcaaaggtgaggtgatagccccagctgcagcctggcaccatactatggggctttaccacctgtttacttctggcgccaggagtgggaaatccacctcccttggggacttccctgaccaccgctttcccttctagtgaatgagatgcagttccctccctctgcccagtcccggccgggggtaccaggctggggcattgccctgctggtgctggtctgtattttggttgctttggctatcgtctatttccttgccctggtaagtctcaagccttctgcggcgcggtgtgcccttggtaaatggaaggggactggccaatccaatctcctgtctccctaggcagtgtgccagtgccgccgaaagagctatgggcagctggacatctttccaacccaggacacctaccatcctatgagtgaataccctacctaccacactcacggacgctacgtgccccctggcagtaccaagcgtcagccctatgaggaggtaaagtgtatcccgaagaagcttgggccatcgacctgggcagggtggggccttct

SEQ ID NO: 69 - protein, 630 aa, Homo sapiens
MTPGIRAPFFLLLLLASLKGFLALPSEENSVTSSQDTSSSLASTTTPVHSSNSDPATRPPGDSTSSPVQSSTSSPATRAPEDSTSTAVLSGTSSPATTAPVNSASSPVAHGDTSSPATSPLKDSNSSPVVHSGTSSAATTAPVDSTSSPVVHGGTSSPATSPPGDSTSSPDHSSTSSPATRAPEDSTSTAVLSGTSSPATTAPVDSTSSPVAHDDTSSPATSLSEDSASSPVAHGGTSSPATSPLRDSTSSPVHSSASIQNIKTTSDLASTPDHNGTSVTTTSSALGSATSPDHSGTSTTTNSSESVLATTPVYSSMPFSTTKVTSGSAIIPDHNGSSVLPTSSVLGSATSLVYNTSAIATTPVSNGTQPSVPSQYPVSPTMATTSSHSTIASSSYYSTVPFSTFSSNSSPQLSVGVSFFFLFFYIQNHPFNSSLEDPSSNYYQELKRNISGLFLQIFNGDFLGISSIKFRSGSVVVESTVVFREGTFSASDVKSQLIQHKKEADSYNLTISEVKVNEMQFPPSAQSRPGVPGWGIALLVLVCILVALAIVYFLALAVCQCRRKSYGQLDIFPTQDTYHPMSEYPTYHTHGRYVPPGSTKRQPYEEVSAGNGSSSLSYTNPAVVTTSANL

SEQ ID NO: 70 - DNA, 755 bp, Homo sapiens
ctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaa

SEQ ID NO: 71 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 72 - DNA, 1524 bp, Homo sapiens
agcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctg

SEQ ID NO: 73 - protein, 118 aa, Homo sapiens
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 74 - DNA, 1602 bp, Homo sapiens
atgttcttggctgttttgtattgccttctgtggagtttccagatctctgatggccattttcctcgagcctgtgcctcctctaagaacttgttggcaaaagaatgctgcccaccatggatcggtgatgggagtccctgcggccagctttcaggcagaggttcctgccaggatatccttctgtccagtgcaccatctggacctcagttccccttcaaaggggtggatgaccgtgagtcctggccctctgtgttttataataggacctgccagtgctcaggcaacttcatgggtttcaactgcggaaactgtaagtttggatttgggggcccaaattgtacagagaagcgagtcttgattagaagaaacatttttgatttgagtgtctccgaaaagaataagttcttttcttacctcactttagcaaaacatactatcagctcagtctatgtcatccccacaggcacctatggccaaatgaacaatgggtcaacacccatgtttaatgatatcaacatctacgacctctttgtatggatgcattactatgtgtcaagggacacactgcttgggggctctgaaatatggaggcagattgattttgcccatgaagcaccagggtttctgccttggcacagacttttcttgttattgtgggaacaagaaattcgagaactaactggggatgagaacttcactgttccatactgggattggagagatgcagaaaactgtgacatttgcacagatgagtacttgggaggtcgtcaccctgaaaatcctaacttactcagcccagcatccttcttctcctcctggcagatcatttgtagcagatcagaagagtataatagccatcaggttttatgcgatggaacacctgagggaccactattacgtaatcctggaaaccatgacaaagccaaaacccccaggctcccatcttcagcagatgtggaattttgtctgagtttgacccagtatgaatctggatcaatggatagaactgccaatttcagctttagaaacacactggaaggatttgccagtccactcacagggatagcagatccttctcaaagtagcatgcacaatgccttacatatctttatgaatggaacaatgtcccaagtacagggatcggccaacgatcccatttttcttcttcaccatgcttttgtggacagtatttttgaacaatggctgcgaaggcaccgccctcttttggaagtttacccagaagccaatgcacctatcggccgtaacagagactcttacatggttcctttcataccgctctatagaaatggtgatttcttcataacatccaaggatctgggatatgactacagctacctccaagagtcagatccaggcttttacagaaattatattgagccttacttggaacaagccagtcgtatctggccatggcttcttggggcagcactggtgggagctgttattgctgcagctctctctgggcttagcagtaggctatgccttcagaagaagaagaagaagaagcaaccccaggaggaaaggcagccactcctcatggacaaagacgactaccacagcttgctgtatcagagccatctgtga

SEQ ID NO: 75 - protein, 533 aa, Mus musculus
MFLAVLYCLLWSFQISDGHFPRACASSKNLLAKECCPPWIGDGSPCGQLSGRGSCQDILLSSAPSGPQFPFKGVDDRESWPSVFYNRTCQCSGNFMGFNCGNCKFGFGGPNCTEKRVLIRRNIFDLSVSEKNKFFSYLTLAKHTISSVYVIPTGTYGQMNNGSTPMFNDINIYDLFVWMHYYVSRDTLLGGSEIWRQIDFAHEAPGFLPWHRLFLLLWEQEIRELTGDENFTVPYWDWRDAENCDICTDEYLGGRHPENPNLLSPASFFSSWQIICSRSEEYNSHQVLCDGTPEGPLLRNPGNHDKAKTPRLPSSADVEFCLSLTQYESGSMDRTANFSFRNTLEGFASPLTGIADPSQSSMHNALHIFMNGTMSQVQGSANDPIFLLHHAFVDSIFEQWLRRHRPLLEVYPEANAPIGRNRDSYMVPFIPLYRNGDFFITSKDLGYDYSYLQESDPGFYRNYIEPYLEQASRIWPWLLGAALVGAVIAAALSGLSSRLCLQKKKKKKQPQEERQPLLMDKDDYHSLLTQSHL

SEQ ID NO: 76 - DNA, 2130 bp, Homo sapiens
cgcggaatccggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctgaaaaaaaaaaaaaaa

SEQ ID NO: 77 - protein, 661 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 78 - DNA, 6471 bp, Homo sapiens
ccaaaaacctgcccgttttcactgctaggaggccttgggagggcattagggagagacgctagcgtgctccagtcctcttgggggttcatggaatgggaacttgatctgaaaaacagtcctggagagaagagggagggagtggaggccgtatcaggaataataggttgaggaagactgagggtcctccatgccatttcagacggagggcagtggagccctacctggagtctgggaggccataccccactgtggatggatgtgattctacctctcttgcaccttgcaggtctcaaggatgggaggggcttattcggaggtgaaagactcagatgcatagaggcagggagccagacaatgtcaggagtccaggaacagcctctcaggaaggcaggaagggaacaccatgactggtagtgctgcctgtcctgtccctgtgcctgctgccagccatggaggagcccatcaggtccccagatttacaaatttctgacttccattttgggagtcagccagagggagatttctctgaggagggcagcttcagttaaacagagggagtagcccagggctgggcactcaacaagaagagaactctgtcgaaggacagtgacctccgaacacggggggagggcacaggctgcaccctgccactccctgctgtcagccctggaaaaggtgggtgtgagtgtcaagactggggaggtgggagggaagaggtcagcagggcttagggagtgagcagaaaggtttggagcacatcctggaggtgggaaggaagggatggaaaggaggctgacaagcgggcggcgggcggggggccgccttcctcctctgagaggaggccccgccccacgctatccgggctgtcagccctgatcaaccctgacagagttcccggatgtgctttgccggatgtgctttcccggcggccatcttgggagtctgaaggacctgaggcattttgtgacgaggatcgtctcaggtcagcggagggaggagacttatagacctatccagtcttcaaggtgagggccccgagggagaagttgagggacaaccccaccacagagagaagcagccctggcctgccctatccctgcggtggcacttgtaggtggcggaaacgaagatggtagccgagggctgagggacgtgtcctcacggcagaagaagggaggaaatgccggccctctagagaataaataggaaggcattgaggaggaccgggggaacccccacctcagaggacagattcccagagattcccacctgctcctcaaatcagcccccatagagctctccaggtggctgaggctgagcggccaccctctcactgctgggtgagggggtgtgggggagggggaggaggaggccttgttctgggggtcccatggcaagtcagcatggggagctgcctccagttggcagagggaagattcccaggccctgctgggaacaagagtgaggactgaggggtcacatgtgcgtcagaacagacgtgaggccacagggaccgcgtcccgtggtagagtgctgggaggtgctgccacctcactacctcccactgctctcagtgatgtggagttttcctgaggtttttcctcaggccagcagagtggtggggcctggccctgtctgagaaaatgtgacaatgctaattgaattctgagggggtcacgaacctcagaattgtgggactctgggagtctggccagccccagctgccgtcttagctggaggggctccctcccttcctcttgcaggtgctccagaaagcaggagttgaagacctgggtgtgagggacacatacatcctaaaagcaccacagcagaggaggcccaggcagtgccaggagtcaaggtgagtgcacgacctgactgtgtaccaagggccgtacccccagaaacagtgtcagacctggcagcaccggccctgtagccacccactgtcattcctggtgcctcatggctctgcctgccagctgtgccccgaggtgctttctcgcgtccttctacaggttcccagaagacaaaccccctaggaagacaggcgacctgtgaggccctagagcaccaccttaagagaagaagagctgtaagccggcctttgtcagagccatcatgggtgagtttctcagctgaggccactggcactgtccctctctccctcagtcctgtgggatcccatcatacctattcgtgttcacacgtttacctgctgctcctgaacaatattcatcatgcctctctttctaaaccttccacgccccagctttgagcaaggcttccagaaggcaattttcatactggagttggtagatgcagaggatcccccagatgaggaagaggaggaagcttcctccattttctcttcctctttccactttttattcccctcgtcctcctcctgtttttctttctcatcctcatcctcctctctgcttctgcgttctccaggggacaaggatatgcctactgctgggatgccgagtcttctccagagttcctctgagagtcctcagagttatcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtattcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaagtcagagaacttctgagggttttgcacagtctcctctccagattcctgtgagctcctcctcgtcctccactttactgagtcttttccagagttcccctgagagaactcagagtacttttgagggttttccccagtctccactccagattcctgtgagccgctccttctcctccactttattgagtattttccagagttcccctgagagaactcagagtacttttgagggttttgcccagtctcctctccagattcctgtgagctcctcctcctcctccactttattgagtcttttccagagttcccctgagagaactcagagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcagagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagagccctcagggggaggactccctgtctcctcactactttcctcagagccctcctcagggggaggactccatgtctcctctctactttcctcagagtcctcttcagggggaggaattccagtcttctctccagagccctgtgagcatctgctcctcctccactccatccagtcttccccagagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaagtgtcagtgactcattatttgatgacattgtatcagcatttgcccatag

SEQ ID NO: 79 - protein, 1142 aa, Homo sapiens
MGDKDMPTAGMPSLLQSSSESPQSYPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESIQSPFEGFPQSVLQIPVSAASSSTLVSIFQSSPESTQSPFEGFPQSPLQIPVSRSFSSTLLSIFQSSPERSQRTSEGFAQSPLQIPVSSSSSSTLLSLFQSSPERTQSTFEGFPQSPLQIPVSRSFSSTLLSIFQSSPERTQSTFEGFAQSPLQIPVSSSSSSTLLSLFQSSPERTQSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTQSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQLIIDTTDDSTATESASSSVMSPSFSSE

SEQ ID NO: 80 - DNA, 1004 bp, Homo sapiens
cgccaatttagggtctccggtatctcccgctgagctgctctgttcccggcttagaggaccaggagaagggggagctggaggctggagcctgtaacaccgtggctcgtctcactctggatggtggtggcaacagagatggcagcgcagctggagtgttaggagggcggcctgagcggtaggagtggggctggagcagtaagatggcggccagagcggtttttctggcattgtctgcccagctgctccaagccaggctgatgaaggaggagtcccctgtggtgagctggaggttggagcctgaagacggcacagctctgtgcttcatcttctgaggttgtggcagccacggtgatggagacggcagctcaacaggagcaataggaggagatggagtttcactgtgtcagccaggatggtctcgatctcctgacctcgtgatccgcccgccttggccttccaaagtgccgagattacagcgatgtgcattttgtaagcactttggagccactatcaaatgctgtgaagagaaatgtacccagatgtatcattatccttgtgctgcaggagccggctcctttcaggatttcagtcacatcttcctgctttgtccagaacacattgaccaagctcctgaaagatgtaagtttactacgcatagacttttaaacttcaaccaatgtatttactgaaaataacaaatgttgtaaattccctgagtgttattctacttgtattaaaaggtaataatacataatcattaaaatctgagggatcattgccagagattgttggggagggaaatgttatcaacggtttcattgaaattaaatccaaaaagttatttcctcagaaaaatcaaataaagtttgcatgttttttattcttaaaacattttaaaaaccactgtagaatgatgtaaatagggactgtgcagtatttctgacatatactataaaattattaaaaagtcaatcagtattcaacatcttttacactaaaaagcc

SEQ ID NO: 81 - protein, 43 aa, Homo sapiens
MAARAVFLALSAQLLQARLMKEESPVVSWRLEPEDGTALCFIF

SEQ ID NO: 82 - DNA, 646 bp, Homo sapiens
ctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactatgttgcccagactgggattctctggcttttaatgaacaattgcttcttaaatctttccccacggaaaccttgagtgactgaaatatcaaatggcgagagaccgtttagttcctatcatctgtggcatgtgaagggcaatcacagtgttaaaagaagacatgctgaaatgttgcaggctgctcctatgttggaaaattcttcattgaagttctcccaataaagctttacagccttctgcaaagaaaaaaaaaaaa

SEQ ID NO: 83 - protein, 138 aa, Homo sapiens
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 84 - DNA, 766 bp, Homo sapiens
ctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtg

SEQ ID NO: 85 - protein, 188 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 86 - DNA, 2974 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattgctgattctttaaatgtcttgtttcccagatttcaggaaactttttttcttttaagctatccactcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaaaaa

SEQ ID NO: 87 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 88 - DNA, 5296 bp, Homo sapiens
ttttttttagtattaagcagaggccgggggcccctggcctccgcttactctggagaaaaagaagagaggcttccagaggcaacttgtcaaaacaggactggcgccttggaggcgctgtggggccacccaaattgatataattaagccccaaccgcctcttcccgcctcatttcagcctcaccaccatcatggatagagttctgagcagagctgacaaagaaaggctgctagaacttctaaaacttcccagacaactatggggggattttggaagaatgcagcaggcatataagcagcagtcactgctactgcacccagacaaaggtggaagccatgccttaatgcaggaattgaacagtctctggggaacatttaaaactgaagtatacaatctgagaatgaatctaggaggaaccggcttccaggtaagaaggctacatgcggatgggtggaatctaagtaccaaagacacctttggtgatagatactaccagcggttctgcagaatgcctcttacctgcctagtaaatgttaaatacagctcatgtagttgtatattatgcctgcttagaaagcaacatagagagctcaaagacaaatgtgatgccaggtgcctagtacttggagaatgtttttgtcttgaatgttacatgcaatggtttggaacaccaacccgagatgtgctgaacctgtatgcagacttcattgcaagcatgcctatagactggctggacctggatgtgcacagcgtgtataatccaagtaagtatcaagagggcgggtgggtatttacggcctatattcttacagggctctccccctagaacggcggagcgaggaactgaggagagcggccacagtccactacacgatgactactggtcattcagctatggaagcaagtacttcacaagggaatggaatgatttcttcagaaagtgggaccccagctaccagtcgccgcctaagactgccgagtcttctgagcaacccgacctattctgttatgaggagccactcctatcccccaacccgagttctccaacagatacacccgcacatactgctggaagaagacgaaatccttgtgttgctgagcccgatgacagcatatccccggacccccccagaactcctgtatccagaaagcgaccaagaccagctggagccactggaggaggaggaggaggagtacatgccaatggaggatctgtatttggacatcctaccggaggaacaagtaccccagctcatccccccccctatcattcccagggcgggtctgagtccatgggagggtctgattcttcgggatttgcagagggctcatttcgatccgatcctagatgcgagtcagagaatgagagctactcacagagctgctctcagagctcattcaatgcaacgccacctaagaaggctagggaggaccctgctcctagtgactttcctagcagccttactgggtatttgtctcatgctatttattctaataaaacgttcccggcatttctagtatactccaccaaagagaaatgcaaacaattatatgataccatagggaagttcaggcccgaattcaaatgcctggtccattatgaggaggggggcatgctgttctttctaactatgactaagcacagggtttcagcagttaagaattattgctctaagctttgcagcgtcagcttcctaatgtgtaaggcagtcaccaagcctatggaatgctatcaagttgtaaccgcagcaccatttcagttaataacagaaaataagccaggcctccaccaattcgagtttacagacgagccagaagaacagaaagcagtagactggattatggtagcagactttgcactagaaaacaaccttgatgatcccctgttaattatggggtattatcttgattttgccaaagaggttccttcatgcataaagtgtagcaaagaggaaacccgcctccaaatacattggaaaaaccatagaaagcatgcagagaatgcagacctcttcctgaattgtaaagctcaaaagacaatctgtcagcaggcagctgacggagtcttggcatccaggagactgaaattagtagagtgtacccgcagccagctattaaaggagagattgcaacagtctctcctcaggctaaaagaacttggctcctccgatgctctactctacctagcaggtgtcgcttggtaccagtgtcttttagaggactttcctcaaaccctgtttaagatgcttaagctgctaacagaaaatgtgccaaaacgacgcaacatactttttagaggaccagttaattcaggaaagacaggcctagcagccgcgcttattagcctgttaggaggcaagtctctcaacataaattgccctgcagataaacttgcttttgagcttggtgtggcacaggaccagtttgtggtctgttttgaagatgtaaagggtcaaatagccttgaacaaacaactgcagccagggatgggagtggctaatctagataatctcagggactacctggatgggagtgtaaaggtcaatctagaaaaaaagcacagcaacaaaaggtcacaactctttccaccctgtgtgtgtacaatgaatgaatatctcctaccacaaacagtatgggcccggtttcacatggtgttggatttcacctgcaaaccccatctggcccaatctcttgaaaagtgtgaatttttgcaaagggaaagaattattcagagtggagatacccttgccctattactcatatggaatttcacttcagatgtatttgatcctgatattcagggtcttgtgaaggaggttcgtgaccagtttgctagtgagtgctcctacagtttgttttgtgatatactttgtaatgtgcaagaaggcgacgaccccttgaaggacatatgtgaatatagctgaatacacagtttattgaataaacattaatttccaggaaatacagtctttgtttttccaaagcggtcaacatagcgcgtcatatcagggtcccccggtacaggttcagtcccatcatacactctaacctcctctacctgggtgttctccccttccatgggttggccctgcacttgggggagcatgttgttgaaaagggaacttatgagggaggccatgggatagggatttttgacccatctttttctcagggtgattttgaaatatctgggaagccctctccagtgatggacatcatagtttcttgtaactctcctgcccattatatctacacaggagaggtataggccctctcctttacagaggggcccaactccattttcatctaggagcacagttgtcagggtgtttgtgaactgcaggacgggtggagttgttgtgcctccagtgtaattgccaaagtaccttgtgttctcattttttgctggatctggatgccagatttcaactggatacattccgtccttatccagcttggccttgctaattggattcaggacttggtctttgttgaccatgtccttctttgtgattgttttgattgttactaccccttcttccttgtattttgttctggcatctgtcacaagtccctggaggtcaagcggttccccgcccacagcaaacacatgatattggctgccttccactggagtggaaattacttttgtgtttactgtatctgtgggtttgttgaacccatgcacatctaacagtgagccagagcccaccacctcggttttcactgagactgcctcccacatttgtagggtgtcacaggtgaggtcctcattgagcatgggaagctggagctttgccatactccatgtgggaagtgtattattttctggggaatcctctgtatctgatgtagccaaattaatccctctgctccaaccatagtattgccctccctctgttaggctttcaggggtgggtggctgccccattctggggttcagaaaagcttctatttctgtcacactgtctggccctgtcacaaggtccagcacctccataccccctttaataagcagtttgggaacgggtgcgggtcttggacaggcctttgtacattttgtctcgcatttagagacgccgctttttcttttgggggccatcttcctctatgactgttgcccaagtaggtgtgatatcaccgtacagccctagaattaaaggaagcatccagtcaggagtgactctttggtgggcaccacctggggcctgatagaactttatcacctcacctgactcatcctgtatatgtgctgcaggggtaggcccaccatttcccatgctcccttctatgcgattaaagagtgctctcctctgtggtggattaagacctagttgcctataatagtcacttagtgatgagtaccctgagctcactgatgaggcacctctgttgattgcatctatggctgactgaggagcattagaaaccacccaccgggtgttttcaagtagcctagctaggccatccaggaatgtatgtgtctgtcttacagttagttctcttacagctccttccagtctgtgttgtgtttcctgcacaaccatttgccacacatatcttcccacggaatgaagtaggccatggccccaatcatgtactacatttagagcatgagcaaactgattaactcctgggaagtatatatcgagaagggctggatcccgccatggtatcaacgccatatttctatttacagtagggacctcttcgttgtgtaggtaccgctgtattcctagggaaatagtagaggcaccttgaactgtctgcatcagccatatagcccccgctgttcgatttacaaacacaggcacagtactgacaaacccatacacctcctctgaaatacccatagttgctagggctgtctccgaactcattacaccctccaaagtcagagctgtaatttcgccatcaagggcagcgagggcttctccagataaaatagcttctgccgagagtcccgtaagggtagacacttcagctaatccctcgatgaggtctactagaatagtcagtgcggctcccattttgaaaattcacttacttgatcagcttcagaagatggcggagggcctccaacacagtaattttcctcccgactcttaaaatagaaaatgtcaagtcagttaagcaggaagtgactaactgaccgcagctggccgtgcgacatcctcttttagttagttgctaggcaactgccctccagagggcagtgtggttttgcaagaggaagcaaaaagcctctccacccaggcctagaatgtttccacccaatcattactatgacaacagctg

SEQ ID NO: 89 - protein, 783 aa, Homo sapiens
MDRVLSRADKERLLELLKLPRQLWGDFGRMQQAYKQQSLLLHPDKGGSHALMQELNSLWGTFKTEVYNLRMNLGGTGFQGSPPRTAERGTEESGHSPLHDDYWSFSYGSKYFTREWNDFFRKWDPSYQSPPKTAESSEQPDLFCYEEPLLSPNPSSPTDTPAHTAGRRRNPCVAEPDDSISPDPPRTPVSRKRPRPAGATGGGGGGVHANGGSVFGHPTGGTSTPAHPPPYHSQGGSESMGGSDSSGFAEGSFRSDPRCESENESYSQSCSQSSFNATPPKKAREDPAPSDFPSSLTGYLSHAIYSNKTFPAFLVYSTKEKCKQLYDTIGKFRPEFKCLVHYEEGGMLFFLTMTKHRVSAVKNYCSKLCSVSFLMCKAVTKPMECYQVVTAAPFQLITENKPGLHQFEFTDEPEEQKAVDWIMVADFALENNLDDPLLIMGYYLDFAKEVPSCIKCSKEETRLQIHWKNHRKHAENADLFLNCKAQKTICQQAADGVLASRRLKLVECTRSQLLKERLQQSLLRLKELGSSDALLYLAGVAWYQCLLEDFPQTLFKMLKLLTENVPKRRNILFRGPVNSGKTGLAAALISLLGGKSLNINCPADKLAFELGVAQDQFVVCFEDVKGQIALNKQLQPGMGVANLDNLRDYLDGSVKVNLEKKHSNKRSQLFPPCVCTMNEYLLPQTVWARFHMVLDFTCKPHLAQSLEKCEFLQRERIIQSGDTLALLLIWNFTSDVFDPDIQGLVKEVRDQFASECSYSLFCDILCNVLQEGDDPLKDICEYS

SEQ ID NO: 90 - DNA, 1504 bp, Homo sapiens
cctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaacaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgac

SEQ ID NO: 91 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPQQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 92 - DNA, 2026 bp, Homo sapiens
tggagttcacacacacatctacatggagatcacacacactctacatggagctcacacatacgcctcaacatggagatcacacaacatcagagatgacacacacaacacagagatcacacaagtcaacatggagatctctctctctctacacacacacacacacacacacacacacacacacacacacactggcacaagcccagcattcatggcgcagccatctcttgtacttgctagcaaaacaccacctgtggaaagtcagctcaaacttccaacctcatccctcacaaagggggaatggagggtttggttttggctttcactggagtctgcaacaagaactggcatcatgctgcccatttcccgcctctccccacccagacccctgcctcagggacgcctgtcctcagcccagccctcagctgcagccaggccttcagcctccgtaacccccgctcagggtccccaccccctgcagccctgtccctccagatgcatggccttgtcctgtgtgggggtggccgagagcactgccccagccctgggtaccttgggcaggaagctggcagaggccagggctgccattcaaacaggggcaggtggttttgccaggaggaagttgacagttcaacttcaaacatgggtgacgcaggccccacactgcctgctccccgtcccacccctccctgagcacgccaccccgccctctccctctctgagagcgagatacccggccagacaccctcacctgcggtgcccagctgcccaggctgaggcaagagaaggccagaaaccatgcccatggggtctctgcaaccgctggccaccttgtacctgctggggatgctgggtgagtacccctcccaggtgtcctgcgaacacccgggctcgctccagtgcaaggaaggagttcccagttttacccaaggctgactctgggatccacatgtcagccctctggagcgttgtggagatttggggccactgggatccctgcctgcccccactaagccgcagcttggccctctgtcctgcatgtcccacccgccaggagcacaaccttgcctctctcatgcgctgttgagaaccctgctttacccttccagtgcaagagagactgcaggggggacccgcatttgatggggcccagacaacttgattcctaggctgagttggattttagcagagcattcaggcctccctctgcgaggtcccccactgacagcccagtctttacttggtcgcctccagagacatggaaactcgccgtctccgaggcagctctgatgatgctctggacagacagcgggccgaggcagggtgggagccgcctctgaggacgatgtctgagcaaatgtcaaggactcatagcggaagtcctagggcctctcatgcccagtcctgggtcaagtcccagaggggcccagccaggccggctgggatgagtacacgctgggcctgctctcactccagccctgggttgtaagcccaaccctgtgtgacctcggataggtccccaagcctctccaggccttgatctccccatttatgaaatgtgggggttgggggtgtgaactggatgaggcctgacccacttcctgaggatttagaaggtctggcagggtgacagaggtgcgtgactctgggctggaaacaggaggatgcgagcagcttccaggctggcagggagagggtcccgaggcctcgcctgcctgagcagggagcctcagcagccttctagggaaaccggtgtgcaggtgtgagtgtgggggaatgcatgtgtgtgtgtctgtgtgcatgtgtgtgagaactgtgtgtgggggaatgtgtgagtctatgtgtgtctgtgtgagtctgtgtgtacgtgtgtgagaactgtgttggggggtaatgtgtgactctgtgtgtgagtctgtgtgtgagtctctggccatgtgtgtgagtactgtgtgtaggggaatgtgtgagtctgtgtgtgagtctgtgtgtgagtctctgggcatgtgtgtgagtactgtctgggggg

SEQ ID NO: 93 - protein, 495 aa, Homo sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFAKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSRLSAYPALEGVLHRSSMQPDNSSDSDYDLHGAQRL

SEQ ID NO: 94 - DNA, 1586 bp, Homo sapiens
gaggacaggtttgtgcgctggacgcaagcaccaggcgcagcctcgctcgccgacacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcccttttctctgctcaataaatattttaaaagca

SEQ ID NO: 95 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 96 - DNA, 1204 bp, Homo sapiens
ggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcggtagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccacc

SEQ ID NO: 97 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 98 - DNA, 1514 bp, Homo sapiens
agactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcagcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttc

SEQ ID NO: 99 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 100 - DNA, 672 bp, Homo sapiens
atggcttgccttggatttcagcggcacaaggctcagctgaacctggctgccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgacggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattga

SEQ ID NO: 101 - protein, 223 aa, Homo sapiens
MACLGFQRHKAQLNLAARTWPCTLLFFLLFIPVFCKAMHVAQPAVVLASSRGIASFVCEYASPGKATEVRVTVLRQADSQVTEVCAATYMTGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 102 - DNA, 2339 bp, Homo sapiens
acgaaggccacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctgctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgggcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgagagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagta

SEQ ID NO: 103 - protein, 567 aa, Homo sapiens [sequence omitted]

SEQ ID NO: 104 - DNA, 1874 bp, Homo sapiens
gaattccggcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaatgaactttaagtatgagaaaagttcagcccaagtaaaataaaaactcaatcacattcaattccagagtagtttcaagtttcacatcgtaaccattttcgcccggaattc

SEQ ID NO: 105 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 106 - DNA, 3120 bp, Homo sapiens
ggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctg

SEQ ID NO: 107 - protein, 866 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWEVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 108 - DNA, 578 bp, Homo sapiens
ctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagca

SEQ ID NO: 109 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 110 - DNA, 1048 bp, Homo sapiens
ctgtgaaagaaggaagcatgtggtccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcaccgtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcagcaggacagagactgtataggctgaccagaagcatgctgctgaattatcaacgaggattttcaagttaacttttaaatactggttattatttaattttatatccctttgttgttttgtagtacacagagattatagagatacacatgcttttttcccaaaattgtgacaacattatgtggaatcttttattatttttaaaataaaaagatataattataaaaaaaaaaa

SEQ ID NO: 111 - protein, 243 aa, Homo sapiens [sequence omitted]

SEQ ID NO: 112 - DNA, 1040 bp, Homo sapiens
cgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtg

SEQ ID NO: 113 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 114 - DNA, 1358 bp, Homo sapiens
tggaagactgtgaagcagaggcgcccagggctatggctgacgctatcacgtatgcagacctgcgctttgtgaaagtgcccctgaagaacagcgcatctaaccatctaggacaggactgtgaggcctatgaagatggggaactcacctacgagaacgtgcaagtgtctccagtcccaggagggccaccaggcttggcttcccctgcactagcggacaaagcaggggtcgggtcagagcaaccaactgcgacctggagctctgtgaagtcgtctgctctcaggcagattccccgctgtcctacggtctgcttgcaaaacttcttgcttggccttctcctgtcctgtctgatgttaggggtggctgtcatctgcctgggagttcgctatctgcaggtgtctcagcagttccaggaggggaccaggatttgggaagccaccaatagcagcctgcagcagcagctcagggagaagataagtcagctggggcagaaggaggtggagcttcaggagtctcagaaagagctgatctcgagccaggacacattacaggagaagcagaggactcacaaggacactgagcagcaactacaagcctgccaggctgagagagcgaagaccaaggagaacctgaaaactgaggaggagcggaggagggacctggaccagaggttgacaagcacgcgggagacactgaggcgcttgtcctcctgttcatcagacacctgctgtccatgcggatggattccatatcaggaaaggtgcttttacatctcacataccctcagaagtctggaggagagccaaaaatactgcacatctctgtcctccaaactggcagcattcgatgaaccttctaagtattactatgaatacctctctgacgccccccaggtttctctgcccagcggcttagaggagttgctagatcgttcgaagtcatattggatacagatgagcaagaagtggaggcatgactatgactctcaaagccgatattgtgacaagataaaaaaatattaccagaagtggaaaagaacattttctgagtgtgcagagcttcacccctgcatttgtgagtcggaggctttcaggtttcctgatgggatccatctgaactgaaccggatacttgaacaagaccttgtgacctacatccttaacctaaggcctgccaatttttaagactgctattcctccagcactccctcactctcgggcatgcccagctaagggatgacctgctgcttgcttgaaagctgctccagaaactggactactcttgggaagagtaaagaagcctccagaaaagacttgaccttccttaaatacttcccaaactagagatgggtcaggggagggc

SEQ ID NO: 115 - protein, 359 aa, Homo sapiens
MADAITYADLRFVKVPLKNSASNHLGQDCEAYEDGELTYENVQVSPVPGGPGLASPALADKAGVGSEQPTATWSSVKSSALRQIPRCPTVCLQNFLLGLLLSCLMLGVAVICLGVRYLQVSQQFQEGTRIWEATNSSLQQQLREKISQLGQKEVEQESQKELISSQDTLQEKQRTHKDTEQQLQACQAERAKTKENLKTEEERRRDLDQRLTSTRETLRRLSSCSSDTCCPCGWIPYQERCFYISHTLRSLEESQKYCTSLSSKLAAFDEPSKYYYEYLSDAPQVSLPSGLEELLDRSKSYWIQMSKKWRHDYDSQSRYCDKIKKYYQKWKRTFSECAELHPCICESEAFRFPDGIHLN

SEQ ID NO: 116 - DNA, 856 bp, Mus musculus
gaagttgcctaaagctccaggggatttccctgccctccgagaagaggcccagttcttcccctgcatcggacatccccgaggttctaagggcaggtcaaggcaggcagaagcttcaaaagctcggctgaggaggctacagcttcccgctgccttcaggccgctgcttccgtgcagggatgccggaggaaggtcgcccttgcccctgggttcgctggagcgggaccgcgttccagcgccaatggccatggctgctgctggtggtgtttattactgtgttttgctgttggtttcattgtagcggactactcagtaagcagcaacagaggctgctggagcaccctgagccgcacacagctgagttacagctgaatctcacagttcctcggaaggaccccacactgcgctggggagcaggcccagccttgggaaggtccttcacacacggaccagagctggaggagggccatctgcgtatccatcaagatggcctctacaggctgcatatccaggtgacactggccaactgctcttccccaggcagcaccctgcagcacagggccaccctggctgtgggcatctgctcccccgctgcgcacggcatcagcttgctgcgtgggcgctttggacaggactgtacagtggcattacagcgcctgacatacctggtccacggagatgtcctctgtaccaacctcaccctgcctctgctgccgtcccgcaacgctgatgagaccttctttggagttcagtggatatgcccttgaccacaactccaggatgacttgtgaatattttttttcttttcaagttctacgtatttataaatgtatatagtacacataaaaaaaaaaaaaaa

SEQ ID NO: 117 - protein, 195 aa, Mus musculus
MPEEGRPCPWVRWSGTAFQRQWPWLLLVVFITVFCCWFHCSGLLSKQQQRLLEHPEPHTAELQLNLTVPRKDPTLRWGAGPALGRSFTHGPELEEGHLRIHQDGLYRLHIQVTLANCSSPGSTLQHRATLAVGICSPAAHGISLLRGRFGQDCTVALQRLTYLVHGDVLCTNLTLPLLPSRNADETFFGVQWICP

SEQ ID NO: 118 - DNA, 909 bp, Homo sapiens
atgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttga

SEQ ID NO: 119 - protein, 302 aa, Homo sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 120 - DNA, 1424 bp, Homo sapiens
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaataaaaaaaaaaaaaaaaaaaa

SEQ ID NO: 121 - protein, 323 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 122 - DNA, 1816 bp, Homo sapiens
cttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaacccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacattaaaa

SEQ ID NO: 123 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 124 - DNA, 1879 bp, Homo sapiens
gcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggtggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccc

SEQ ID NO: 125 - protein, 400 aa, Homo sapiens
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 126 - DNA, 3567 bp, Homo sapiens
cgccatcccgcgctctgcggactgggaggcccgggccaggacgcgagtctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgtccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccagttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagcccgccc

SEQ ID NO: 127 - protein, 1038 aa, Homo sapiens [sequence omitted]

SEQ ID NO: 128 - DNA, 8743 bp, Homo sapiens
ggatcctctcgcctcggcctcctaaagtattgggattacaggcatgagcctctgtgcctggctgtaactgacatgttttaagcaggggaatgacatgctctagtgaaagccagtctgggcagctgggtagctaatgaggggattagagagattttgttgaatgaaaggcagattgagtcctgctactcgcccccttcattccccttcattcatgcctcattcttccgcctcccagccgcctcaactggccaaagggaagtggaggccctgccacctgtagggagggtcccctggggcttgcccacagcaaacaggaagtcacagcctggtgagatgggcctgggaatcagccactgagaaagtgggtctcttgggtccctgaattctttttctgagtccctgcagcagtgaaaaagacacagaggcacatagagagtgacagagaaagagagagacagagaggagaggcatggggcagaataagaacagatttaggagttagaactcctgggttcttttaaaacaatttttcttttagagacagggtcttgttgtgttgcccggactggagcacagtggctattcccaggcataatcatggtgcactgcagccttgaactcctgggctcaagcgatccttctacctcagcctcccaaggacctgggaccataggcgtgtaccactgtgcctggcttttgcctggttttaaactgaggcagtatgacttgagctcttaggcattaattgaagctgtatctcattaactgagggcttatgatgtgctggacactgggctaatagtgctgaacatattgtcatttttaatcttcacaaacaatatttgtataggactgttttcttttcttttttttttttgaaacagagtctcactctggtgcccaggctggagtgcagtggtgtgatctcggctcactgcaacctccgcctcctggtttccagtgattctcctgcctcagcctcctaagtagctgggattacaggtgtgcgccaccatgcccggctaatttttttttttttttttgagaaggagtctatgtgcccagcattgttctagagcacttgcaattagtggtgaacaacacggtctctactccaaggggctcacattcttgtgcagaaaacagaaatgaacaaataaacacacaagatcatttcccgtggtagtgagagctgggatgaaaataaaacagcgtggcagggaggaggcaagtgttgtgagtctggagggttcctggagaatggggcctgaggcgtgaccaccgccttcctctctggggggactgcctgccgcccccgcagacacccatggttgagtgccctccaggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaaggtatgtccaaagggcagaaagggaagggattgaggctggaaacttgagttgtggctgggtgtccttggctgagtaacttaccctctctgagcctccattttcttatttgtaaaattcaggaaagggttggaaggactctgccggctcctccactcccagcttttggagtcctctgctctataacctggtgtgaggagtcggggggcttggaggtcccccccacccatgcccacacctctctccctctctctccacagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggcatcctggcttttcatcttcaacgtctctcaacagatggggggcttctacctgtgccagccggggcccccctctgagaaggcctggcagcctggctggacagtcaatgtggagggcagcggtgagggccgggctggggcaggggcaggaggagagaagggaggccaccatggacagaagaggtccgcggccacaatggagctggagagaggggctggagggattgagggcgaaactcggagctaggtgggcagactcctggggcttcgtggcttcagtatgagctgcttcctgtccctctacctctcactgtcttctctctctctgcgggtctttgtctctatttatctctgtctttgagtctctatctctctccctctcctgggtgtctctgcatttggttctgggtctcttcccaggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccagggtatggtgatgactggggagatgccgggaagcgggggtccagagacagaggggaggggaaactgaagaggtgaaaccctgaggatcaggctttccttgtcttatctctccctgtcccagacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggtagagtttctctcaactgggaggcatctgtgtgggggtactgggaagaagtggaagccagtcaatcttagattcccccaacccgagggctactcccagcctcaccccaaaccccaacttccacacagaacactgactccaagtctttcttttttttgacagagtctcgctctgttgcctaggctggagtgcagtggtgccatcttgtcttggctcactgcaacctccgcctcccaggttcaagtgattcccctgcctcagcctcctgagtagctgggattacaggtgcccaccaccacgcctggctaattttttttttttttttgagacggagtcttgcactgtcacccaggctggagtgcagtggcacgatctcagctcactgcaacctccaccttccaggttcaagtgattctcctgcctcagcctcccgagtagctgggattaaagcctggctaattttttttgtatttttagtagagatggggtttcattatgttggccaggctggtctcaaactcctgacctcgtgatccacccgcctcggcctcccaaagtgctgggattacagacatgagccacagggccgggccaagcctaattttgtatttttagtagagatggggtttctccctgttggaccaggctggtcttgaactcctgacttcaggtgatctgcctgccttggcctcccaaagtactgggattacaggcataagccaccgcacctggcctagacttcaagtctttcttccctcgcttccaagacactacttttctgggtcttcacctaccattgcttgcgcctgcccaccagcttgggtggagtcttccttcctccccaactcctcactcttggagccctgggccctcttcttatccctgtctgcacactttcctatttgaacttgactctcaatggcttcttgggtcaccatgccttggtgactctattccaggctccatactcagccatctcctgtgccatttgatatcccatggacacctcaggctcaacagatacaaaatcaaactcaatgtcttccccaagtatagtcttcttggtggcccagtgtaagcagagggcaccaccacctgctccctcgcccaggctaagaacctgggcatccttctttttcctcaccccgtccaacaaactggtcacagtgttctgccaattctctctccatgcaatcctatcatgctatcctaactgcaattcacaaacccaaccccaactttcactccaaacttgatccaagcaatgtgctggatcccaactgtaaccttgcaaactcaactctgcccttcactttgaccgtgactatccttaattgcagcaggaaactgatcattatgctcccctcaatccacacattgcctctgagtacagccatggtttgtccacgatttgctcaaagacactgcccatgtcctgtgccagggtctgtgacaatccctgacctcctgggacatggctccttagagagaggagagcctttctcacagcttgggactttgagtctgtgtctttttttttttcttgagacggagttttgctgtggttgcccaggctggagtgcagtgatctcggctcactgaaacctccgcctcccgggttcaaacgattctcctgcctcagcctcccaagtagctgggattacaggcacccaccaccatgcccagctaatttttttgtatttttagtagagatggggtttcaccatgttggccaggctggtctcgaactcctgacctcaggtgatccacccgcctttgcctcccaaagtgctgggattacaggcgtcaaccaccgcgcccggccgagtctgtgtcttgcctctgtgcctcagacttgcggttccttgagatctcaggattgggacgtaagatgccagcctggggtcctcgtctcatagccccttccccctagtactatggcactggctgctgaggactggtggctggaaggtctcagctgtgactttggcttatctgatcttctgcctgtgttcccttgtgggcattcttcatcttcaaagaggtgagtcatgtccccagtgggtctgtccaaaccctactccatcttccccaggataagccggctctggccagtctgacaaccatctttctttcctcccatccctcccttcaagaccccagaatcctgttctccccagtcttcctctagcctccctcaaacttcccaagcctcttgcaattttttttttttttttgagacagggtctcattctgtcaccccagctggagtgcagtggcacaatctgagctcactgtaacctctgcctcccaggcttaagtgattcttgtgcttcagcctcccgagtacctgggactacaagtgtatgccaccacacccggccaattttttatatttttagtagagacgaggtttcaccatgttggccagactggtctcgaactcttgacctcaaatgatccgcccacctcggcctcccaaagtgctgggattacaggcacgagccaccgcgcccgtccgcctcgcaatttgaactcctgtctcctttgttgaaccaagtgacctccccagcacctggccccacaaatcctcaccctgccaagcagcccctcctctgatcacgccctttaactcccaccagccctggtcctgaggaggaaaagaaagcgaatgactgaccccaccaggaggtaatgcaaccagtgcaccccgcggtaacaccctccaccttcactttatgccttgcacttactgtttcctctgcccaggggttctttgctccgtctctactgtttcaaatactgcccaacctcaaagcccagctccaaagctacctcctctgtgaagaactccttggaaatgatcatctcagactcctctattggctgtcccagcacaagtgatcacgtttaacttctgaaggcctggacagaatcttgagtgggtccgccattccattccaagtcggccctcaccgtgcacttcctcttctcccgccagattcttcaaagtgacgcctcccccaggaagcgggccccagaaccagtacgggaacgtgctgtctctccccacacccacctcaggcctcggtaagaggcaccgcccctccagcctatagctccgccccagatccggggctccacccccactctcctcatccctccaatccgctgtgcgccaagccttctggagctcggaactccgcccccggggcggggagtcccgcccagctatgagccccgcctctagaaccagaccccgcctccagggctcagagccacgcccccaggacccagagcctgaagtcgtaatcaagagcagaacttcgccccagaactgaaggcctcggccctagatttagattccgccccagggttcaaggccgggttcctagacccagagtccattcgcagagcccaaaacatcctcttcccgtgccccgccgcgcggacccttagccttgaccgcccccatctcttctgaccccgtcttacaatgcccctctcaccaggacgcgcccagcgttgggccgcaggcctggggggcactgccccgtcttatggaaacccgagcagcgacgtccaggcggatggagccttggggtcccggagcccgccgggagtgggtgaatgactgggagagggaagggtcgttccccacatggagggggttggagcggtctgtggcccgaatagtggactgggccctggaggagagggggcatgactcggttccccatccccatccccaaacccccaggcccagaagaagaggaaggggagggctatgaggaacctgacagtgaggaggactccgagttctatgagaacgactccaaccttgggcaggaccagctctcccagggtaaggctgccctcccccgtggccccccacctctgcggtggcctgtggactcccatggacacccctccttctacaccagatggcagcggctacgagaaccctgaggatgagcccctgggtcctgaggatgaagactccttctccaacggtaacttggggcctttgtgggacctcagagacttaggtgtaattgcagcgctgtgacactcctagaaggggatccctggagttctctctcttctgccacagctgagtcttatgagaacgaggatgaagagctgacccagccggtcgccaggacaatgggtgtgtgtgaggatggcaacagtccaggggggaggcggaggacacctggaggccaggaggaatagtaacctccctcttccctttccagacttcctgagccctcatgggtcagcctgggaccccagccgggaagcaacctccctgggtgagagatgctttcaatcagactgccttgcccagcttgggtgacctggcctcagctctgacaccagatccaactttgacctgaccctgaccccaaacccgaacccaatcctgtgactcctctcacctcaacactgagccccatcccccatcctgagccccatcccccatcctgacccccaatatttaccccctccctaactgtgaatatcaacaccgatcccaatgcagtatcagcctggacttgatctccacctcacctcagccccagtgcagacctcaacttggaccccagcttactctgcagcttcttcatgactctgactccgactccctccagtttcttctttttctttttcttttttttgagacggagtctccctctgttgcccaggctggagtgcagttgccacctctgcctcctaggttcaagcgattctcatgcctcagcctcctgagtagctgggattatagacgtttgccaccacacctggctaatttttgtattttcagtagagacagggtttcgccatgttggccagactggtctccaactcctggcctctagtgatctgcccgcctttggcttcccaaagtgctgggattacaggcatgagccaccacgcccagcccagttctgttcttgaccccttccttagccataatctaacccatatctaaccctgaccctacagctaactggggccccaaactcaatgctaaccaaatcaccccttcccagcacagcatgggtaatgctcctcaccttcctctgcccctcagtcttcctccttaccgtaggctgtacttcccatgccctagcctccaattctccatcccccgcccaagcagggtcccagtcctatgaggatatgagaggaatcctgtatgcagccccccagctccgctccattcggggccagcctggacccaatcatgaggaaggtgggtgcttctgccgctgtcccctgctgtcccctgggctgactttgccttccagcctacttccagtgccacccatgttctcctcctccctggtcctatccagatgcagactcttatgagaacatggataatcccgatgggccagacccagcctggggaggagggggccgcatgggcacctggagcaccaggtgatcctcaggtggccaggtgagctgggactgcccctagggaaagcggggagggagggagataggcacggatggcagtggctgctggctttcagggagggagagggaacagggttcctagggcctggtgggcagggggaggactgctggacccctccccatcaccgtttcttctgcatagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctc

SEQ ID NO: 129 - protein, 556 aa, Homo sapiens [sequence omitted]

SEQ ID NO: 130 - DNA, 1146 bp, Homo sapiens
cctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcttggcagcaacggagaaaaactctaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcc

SEQ ID NO: 131 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 132 - DNA, 3260 bp, Homo sapiens
ccatcccatagtgagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcacgttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagtgacgccaaccctcccgtctcccactacacctggtttgactggaataaccaaagcctcccccaccacagccagaagctgagattggagccggtgaaggtccagcactcgggtgcctactggtgccaggggaccaacagtgtgggcaagggccgttcgcctctcagcacccttactgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctccccggacctgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgtgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatcatctaaatacctgccctgacatgcacacctcccctgccccaccagcccactggccatctccacccggagctgctgtgtcctctggatctgctcgtcattttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 133 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACARCNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPHHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPRTCDDTVTYSALHKRQVGDYENVIPDFPEDEGIHYSELIQFGVGERPQAQENVDYVILKH

SEQ ID NO: 134 - DNA, 1906 bp, Homo sapiens
ccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagagctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaaccactaattcactgtatggtcttgatctatttcttctgttttgagagcctccagttaaaatggggcttcagtaccagagcagctagcaactctgccctaatgggaaatgaaggggagctgggtgtgagtgtttacactgtgcccttcacgggatacttcttttatctgcagatggcctaatgcttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctcggacagccccctgttcctgagatggaaagcacaaatttaatacaccaccacaatggaaaacaagttcaaagacttttacttacagatcctggacagaaagggcataatgagtctgaagggcagtcctccttctccaggttacatgaggcaggaataagaagtcagacagagacagcaagacagttaacaacgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttccggtatgagaaattaaacttgtatacaaaatggttgccaaggcaacataaaattataagaattc

SEQ ID NO: 135 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 136 - DNA, 1125 bp, Homo sapiens
gtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctac

SEQ ID NO: 137 - protein, 281 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 138 - DNA, 2220 bp, Homo sapiens
atgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtag

SEQ ID NO: 139 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 140 - DNA, 2986 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 141 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTREVTVNVLSPRYEIVIITVVAAAVIMGTAGLSTYLYNRQRKIKKYRLQQAQKGTPMKPNTQATPP

SEQ ID NO: 142 - DNA, 591 bp, Mus musculus
atgtcgcaaggcctccagctcctgtttctaggctgcgcctgcagcctggcacccgcgatggcgatgcgggaggtgacggtggcttgctccgagaccgccgacttgccttgcacagcgccctgggacccgcagctctcctatgcagtgtcctgggccaaggtctccgagagtggcactgagagtgtggagctcccggagagcaagcaaaacagctccttcgaggcccccaggagaagggcctattccctgacgatccaaaacactaccatctgcagctcgggcacctacaggtgtgccctgcaggagctcggagggcagcgcaacttgagcggcaccgtggttctgaaggtgacaggatgccccaaggaagctacagagtcaactttcaggaagtacagggcagaagctgtgttgctcttctctctggttgttttctacctgacactcatcattttcacctgcaaatttgcacgactacaaagcattttcccagatatttctaaacctggtacggaacaagcttttcttccagtcacctccccaagcaaacatttggggccagtgacccttcctaagacagaaacggtatga

SEQ ID NO: 143 - protein, 196 aa, Mus musculus
MSQGLQLLFLGCACSLAPAMAMREVTVACSETADLPCTAPWDPQLSYAVSWAKVSESGTESVELPESKQNSSFEAPRRRAYSLTIQNTTICSSGTYRCALQELGGQRNLSGTVVLKVTGCPKEATESTFRKYRAEAVLLFSLVVFYLTLIIFTCKFARLQSIFPDISKPGTEQAFLPVTSPSKHLGPVTLPKTETV

SEQ ID NO: 144 - DNA, 6928 bp, Homo sapiens
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 145 - protein, 1722 aa, Homo sapiens
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNNSLMWFDKTPLSYTHWRAGRPTIKNEKFLAGLSTDGFWDIQTFKVIEEAVYFHQHSILACKIEMVDYKEEHNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 146 - protein, 15 aa, Artificial sequence
  Exemplary linker
GGGGSGGGGSGGGGS

SEQ ID NO: 147 - DNA, 1518 bp, Mouse-human hybrid fusion protein
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 148 - protein, 499 aa, Artificial sequence
  Mouse-human hybrid fusion protein
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - DNA, 1470 bp, Artificial sequence
  2H7scFv-CD154 L2
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatccaagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactcgagtgataatctaga

SEQ ID NO: 150 - protein, 482 aa, Artificial sequence
  2H7scFv-CD154 L2
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 151 - DNA, 1290 bp, Artificial sequence
  2H7scFv-CD154 S4
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatccagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactcgagtgataatctaga

SEQ ID NO: 152 - protein, 422 aa, Artificial sequence
  2H7scFv-CD154 S4
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 153 - DNA, 3630 bp, Homo sapiens
atacgggagaactaaggctgaaacctcggaggaacaaccacttttgaagtgacttcgcggcgtgcgttgggtgcggactaggtggccccggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacagcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttaaaaaaaa

SEQ ID NO: 154 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 155 - DNA, 1824 bp, Homo sapiens
cagctctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacgggctcccggagcgtgtggagctggcacccctgcctccttggcagccggtgggccagaacttcaccctgcgctgccaagtggagggtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 156 - protein, 547 aa, Homo sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYGLPERVELAPLPPWQPVGQNFTLRCQVEGGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 157 - DNA, 5150 bp, Homo sapiens
gagggtgaccaacttagggaccctcagtccgagggcgggtggcctctccctccactccctccctctccagggccagcgggctccacggctgggaatttccccacgggtgggccgaggacaggcagctgtttcctgtgctcctgggaggaggggatttccagccccttccctgctgctctgttcctagaggcccctctccacttgcaacttcaaaaatgaacttttggataatcacaggctggtcacagttatttgaaaggtgcagaaagggcccagggagcccccagccccgcacctgctccccagctctccgggcagttcgcatcctctgggcaaacctggaacctgagaactgtttggatagaaggtggaaacctgcctgcgtgcccgtgtgcgccaggccatccaggacccaccctcaccacctcctcagaggcctgtctccaaacactgccacatgggggttagggcttccacgcaggaatttaaggggcacagttcagccatagacacctgccgtgctcaggcacactcagcgtgggctgtggtcacgggtgtctttttttttttttttgagatgagtctcgccctgtcgcccaggctggagtgcagtggcgccacctctgctttgcaacttctgtctcctgggttcgagtgattctgctacctcagcctcctgactagctgggattaccggcgcccgccaccacgcccgaataatttttgtagttttagtagagacggaatttcgccatgttagccagactggtcttgaactcctgacctcaggtgatccacccgccttggcctcccaaagtgctgggattacaggcgggagccaccgtgcctggccatgggtgtctgtcttaccatggctgtggtcactgctgctcagagctagtcttgggcatacaagggggaccatgcttcagcagtgccacagccctgaaggtccagactgaggagttgcctctcctgactcagtgctgcctcagtttacccacgtgctccatggacctttttgctgagggtcgaaccgcaggccaggccctactgtgccctggggtctgaacacggtggtcttgggcagaagaggtcagaaggcagaataagccaatgctgggggtgcccagaccccgcctttgtgcccagcccacagccagggtccccggcctgccaccttcctcctcccgcctccgctgccctcctcccctctcccctcccctcctccacagtccttatagccacaccccgcaaggaaaacccagactctggcgacagcagagacgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggtgaggcctcaggaggggtcgccacgcacgggcactccagggactgggggctggggcagggatgggccagccaggaggctggtcctggggagggggcgggtgaggggccggccaagcctggcagaggagccgcctgggggggtccacgggcgcaagcctggggcctgaccgctgcctgacgccggcctctgctgcaggcaacgggatggtgagccgctgcagccgctcccagaacacggtgtgccgtccgtgcgggccgggcttctacaacgacgtggtcagctccaagccgtgcaagccctgcacgtggtgtaacctcagtgagctcccacctggccccacagccccacccagcacagggggcggcagcctggcacccacattcccacacagcaacatggggctcccacagccgcagaaacaaacctcaaaccacagcggggtctgctccgccacaggggtccttcgaggaaactgaggcgtctcccaggggcaccccctctccctccgggggcccaaactcggcccaggccacgtggagtcggggagaccacgctggccatgtggcctggccttgctggcctgagcagtgaggctggggggttgggccatggagaccctgccgcaggcggggctggcggctggaggcggtggaggggtagggaagggtggctggggctgccacggaaccagccccaggttgtggccaggaagggagggcccaggagcctcgggggctgcaggggctccaagtatcaggggaggccgcagacccctgcccacggccgtttgtgtggtggggaggccaacctgtcctccagtgcccacgcttcctgaggaccctgtccacagcccccacctgaccacccccccatccggcccctgctcaggaagtgggagtgagcggaagcagctgtgcacggccacacaggacacagtctgccgctgccgggcgggcacccagcccctggacagctacaagcctggagttggtgagctcggtggctgcggccggcggttgggggtgtgcatagcggctgtctgtgacgcagatgggccgtgggccgcagggacctggccccaccggtgcctcctctggcatcctcaagaccgagctcccgggtcagggcccacgggtgggatgtgggcagggagggcttccagaggccaaacccaccacccagccatggggggcaagtgcctgccccacaggctctgccccatgtccccagcacccggggcctgtgggcagcccctgaccaccctatctttgttgcagactgtgccccctgccctccagggcacttctccccaggcgacaaccaggcctgcaagccctggaccaagtgaggggcctggccaggggctgggaggggctgggggggggttggggtggttaggagggcggaggagctggggagctgggagggcctgggggggcaggtggggtgggggccagttttgggggaaggggaggtgctggtgcccctgggggcctggctatgtgcctggacctggttggggagcaggaagctgctgcctgggggcagcctttccctgtgggtggagctgggtgtgtgggaccctcaccctccgcagctgggaggccctgggggcacaggacagggaggtgctggtggggggtgtagatgtgggagaagggtgtgtggccttggaggcccctgtggggggcacgtggggctgggcagcgtccttggctgtcactggcctggtgtctgtggtagatgctgcctgtggctggccagcgtggaccctgttatccccaccgcatctcccgggtcccagggggtttctggcctgagcaacacctcctgttccccaacagctgcaccttggctgggaagcacaccctgcagccggccagcaatagctcggacgcaatctgtgaggacagggaccccccagccacgcagccccaggaaacccagggccccccggccaggcccatcactgtccagcccactgaagcctggcccagaacctcacagggaccctccacccggcccgtggaggtccccgggggtaagggagcctggcccagcccagtggggtccccatcctgaataggagaaggggagggcggaatgggggcccctcctgtggaccccacccagcagaccccttcctgcaggccgtgcggttgccgccatcctgggcctgggcctggtgctggggctgctgggccccctggccatcctgctggccctgtacctgctccggagggaccagaggctgccccccgatgcccacaagccccctggtgagtgcctcatggccctgccgcactgctcctggcgggtgaggcccacccaccaatctctccttttttcctccccagggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggcactgtgggctgcacacctgtggcatggaggcttggcccgtgcccgcctctgactggagaggggtcttgggaggcttgggccgtgcccgcctctggctggacaggggtcttgggaggcttgggccgtgcccgcctctggctggagaggggtcttgggagacttgggccgtgccaacctgtggctggaaaggggtcttgggagacttgggccgtgccaacctgtggctggagaggggtcttgggagacttgggctgtgccaacctgtggctggagaggggtcttggcccagggtggaggtgagggtagcggggtcaagtgggaccctggaggttggtccctgggtgcgagttccagattgagtggggagcggggggagagactgggaaagctcaggcccaaggctgcctggggtggaggttcctggccaggcgctgacaagggcagctggcccctgagccccgggttgcccaaggagcttgggagtggctgacccccggggctctgtgtccttggaggaggagtgtagagacctgcccctcttcccctccacacctacgcccaccccttgctgcacctggaagggggtcccagggcccctgagcaccccgaggagtccctgcaaagggcccacacggcccctatgtccctgccataggtgtccagggggacagtcaccttggaaaccacagtttctgcttgagccaactttctgtccaccctgggccccggccgtcccactcctgcgcacttaagagtcctgggatctgaatgagaatgaccacagcgacttcatgtaacgtggccccacagtggagaaacccaggcatccgccagcagcgtggatgcgcgagtgctggcgtgttcagatgagctcccagctcctcggcccacaccacaggtgtccacagacgctcccaaggccctggggccgtccccggccgtgcgggaatcttctcaagctggtgtctgggagtggggtatccttcgagcagcacagagcctgctcccgagcgccagtcacacccgagaccacagctcgggaacaagacgggagc

SEQ ID NO: 158 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 159 - DNA, 1419 bp, Homo sapiens
ccacgcgtccgagaccaaggagtggaaagttctccggcagccctgagatctcaagagtgacatttgtgagaccagctaatttgattaaaattctcttggaatcagctttgctagtatcatacctgtcgcagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttggacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgttggtaaagatggcatttcgccatgttgtacaggctggtctcaaactcctaggttcactttggcctcccaaagtgctgggattacagacatgaactgccaggcccggccaaaataatgcaccacttttaacagaacagacagatgaggacagagctggtgat

SEQ ID NO: 160 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 161 - DNA, 5784 bp, Homo sapiens
aaaatataattattagggcaacattataaaatgtcacttttgctttgttttctttctttttatgcaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatggtaagacattgctttcatcttccaaacttaagagtatatatatgttttgacaacttttctcactaataaaatcaattagacaaataaatatcttttgtgttggagttcacttagatgcagttgatggtaatcatttataatgaagatatacaggtgatgatttactattaatcataattagtattattcagcaatatgcaatgtaatcccatagactgctaagtcagaaatagatcatattgccttttaaacacatatgctattaaaaatcaggaaaaacattaagacaaatacttaaacttatggcttaataatgggtattatctctattcacctaagatttaaggtttggttttgcactgtgtttgtggaatgaagtatgatgattgaaaatcatagttttataacattacttttactattacctcttttataaaaatataggcagaaaagccctttctattaaccacatttgtaaatacattatatgcataatcttttaagttttagttcctggatccttgccataatactgagatgatgttagtctaataacttgcccacttactggatttcatgactataataaagaaaagcttcatttgattaaatagctcttttaaatttggtaagagaacttgtggttcagcagaatttttcattaacatacctttttttccaatccagaatcacaactttgttgccagctgaagttctggttacccataggatgtgcagcctttgttgtagtctgcattttgggatgcatacttatttgttggcttacaaaaaaggtaagcgatttctatctttccttgtatctgctttacagatgcacatcagtgattatttcctcatcaaaagtacacatggctcttgtcagagtaatttgaccaacagggagacaattccttccccccaagacatacctactaattaaactaatcacttggaacagaaatttatgtatttgttttatagcccacacattccaaagaggacttgacttgatggcttacagagagttacattattattattattgttcaaactagatgaggaaattgaggtcaagagaagactaaaggtcaggaggaaggttaaaacatcaaaatagatgactctgatttttaaaaaattattatgcatgggctgcgaatttgaatccaaggttcctgagaggcagggcagagatgaaacaattagttataagttttgcttagctggtaagttaaaaacagtcagcaagaaagccttctaaggtgtcaattgtagctgagaaggaaattgacaacttttttacatggtaggttattagactccttgcttttaaagaaaaccactgaggagctatttagaaagataaacaacaatgacaacaacaaaaatctccctgtgctgggggatattctttttggtctcttgcattacaggttctcaatcaaagaactgacaccactctgcatattacgcgagtatgctagtactcaagtatatccacagtgtggtcattggccagtgtatatctgtgggagagtggaatttggaaagagacataaagaaggaagagaatgagatagcgcccatggtctaagtctgctgggaaagaaacaataaaggcaaaaacgaggaagaaagttcagtagaaagctctttttatgtaaagcccttttcatattgtttttctacttagcctaaagccaggaacctaagtcacattatcatgtttttgtcacataccacttcaacaaagaatagaaaacagtcaaaaaacaaagagatggagaagaaaagatgaccaagcatgtttctggctttttctttcagaagtattcatccagtgtgcacgaccctaacggtgaatacatgttcatgagagcagtgaacacagccaaaaaatctagactcacaggtatgactccatttgggggtttgggaagggaagaggtttcttcacagtaagcctggaatgttaatttttttttttttaattttaaaggaaaggaaaacatctccaaggcctaattctagaattttctgtgaaaatctggatttctcacttttaactagatttatattttctgcagtatattgaaaacaaacaagcaataggtttgtaagccactattgaaactaaacacacaaacagctcataaaccaccatagtatcaaggcaattttcccattgatgtttcaaaagttgggatgattctaagtgttttttgttgaagggttcattcagtcattcaatgagcgtttattgagcatcagttaagtgtgagttactgagtgaggcactctggggaatttggacagatatatgctaattttggactgagattaggaagagagatctgtgctggtactgctagagggaagaaggagaaattgatgaagatatctggttattttgaggtaaagagtgtgcaagtttagagaacttggatggctttagaagtctcagtaacatggaaatttgaccttttctgttaagagtcagaaaactgaaagttgccaagtttgaggagcacccagaaagtttgaagcttccattgtggaaaattcatgtcttatgcccttgaggttcgaatgatgtgcgatgtgtaatgagacagaagccactgcatttttccacccctcagtggctacagattatctaaaggggacacacatagcttgcgttgtcatggaattatagcatgggatgggagctaaaaaggatccttgagttcacatttcatgttttagatgacagaaattgatgctcaaagtgttcagtgactcttttggttccctagacagttaatacctagctttgacacttgcaaagagcttatgtttcattactttgctgtttaaaaaatatatgatctctcaatctctttgcttaatgtgttctggctgtttggatccccacaagcagaacctgacataaggacttgggtgcaagtagtttatttgggaggtgatcccaggaagaaggggtgagggggcagggagagtgagacagccaacaaggagaagcaaatgaagggcgcattattatcaaggtctcagctccaggccacagaggcctgacttcattggacctctgagaagtgtacagatgcctcccagaatcattctcttgaaggatggcaaccactggctccatcctcactgatttggggttgcctgcggagggcattagctttccctcatctctgagctgtgcctctacttgggatgagcctacttgggatgagtcttcagagaaagtctggaggcagaaaagcagtgaaatgcagtggggctgttgtgctagaacagtcagcccatgcagcgctttctgccccagcagcagctgcaatcagaggtggacagtttcaaagtgatgagtttagataatgtctgttataggagtcgagagctaaacttctctggaaatggggaactggtgctgggtgttgaagcataaagatgagtttgcatggtgtgtgtgtgagtgtgtgtgtgtgtgtgtgtgcacgtgtgtgtttgtgtgtatgaaaggcaatggagaggggaaagcttcttgtagggaactggcacatggagagcatttagagaatttatgctgaatttttgttacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggg

SEQ ID NO: 162 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 163 - DNA, 822 bp, Homo sapiens
gggctgctccacgcttttgccggagacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgt

SEQ ID NO: 164 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 165 - DNA, 1311 bp, Homo sapiens
gtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaaccccccctcccactgtaggccactggatggtcatttggcatctccgtatatgtgctctggctcctcagctgagagagaaaaaaataaactgtatttggctgc

SEQ ID NO: 166 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 167 - DNA, 3 bp, Homo sapiens
  misc_feature (1)..(3): n = A, T, C or G
nnn

SEQ ID NO: 168 - protein, 2 aa, Homo sapiens
  VARIANT (1)..(2): Xaa = Any amino acid
XX

SEQ ID NO: 169 - DNA, 3084 bp, Homo sapiens
ctgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggagcttgcacgaaatcacacagccaagccagtcaaggatggatgcagatccagaggtttctggcagccagtacctcctgccccatgctgcccgcttctcaccctatgtgggtggggccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagtgcaagctgggagcacaggcactgcaggagagaatgcccagtgaccagtcactgaccctgtgcagaacctcctggaagcgagctttgctgggagagggggtagctagcctgagagggaaccctccaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagataaaaaaaaaaaaaaaaaaaaaaaaaaaaaaaaaaaaaaaaaaaaaaaaaaaaaaaaaaaaaaaaaaaaaaaaaaaa

SEQ ID NO: 170 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 171 - DNA, 2308 bp, Homo sapiens
gagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagg

SEQ ID NO: 172 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 173 - DNA, 1060 bp, Homo sapiens
cggctcccgcgccgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatca

SEQ ID NO: 174 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 175 - DNA, 4740 bp, Homo sapiens
gaattccgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtaagccgctgctgggttttcctccgggagaggggacggtcaatcctgtgggtgaagagagagggaaacacagcagcatctctccactgaaagaagtgggacttcccgtcgcctgcgagcctgcggcctgctggagcctgcgcagcttggatggatactccatgagaaaagccgtgggtggaaccaggagcctcctccacaccagcgctgatgcccaataaagatgcccactgaggaatcatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacaccacacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcatctcttgttattgcatctgctgagttaataaatcaaatatatgtcaaaaaaaaaaaaaaaaaaaaaaaaaaaaaaaaaaaaaaaaa

SEQ ID NO: 176 - protein, 1153 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 177 - DNA, 1364 bp, Homo sapiens
gccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 178 - protein, 375 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 179 - DNA, 2633 bp, Homo sapiens
ccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccgggccaggcagaatattgtgaatgccaccgccaacctcggccagtccgtcaccctggtgtgcgatgccgaacggttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttcgaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagtgggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagc

SEQ ID NO: 180 - protein, 848 aa, Homo sapiens [sequence omitted]

SEQ ID NO: 181 - DNA, 1702 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaaaaaaaaaaaaaaaaaaaaaaaaaaaa

SEQ ID NO: 182 - protein, 199 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 183 - DNA, 1642 bp, Homo sapiens
ctctaaaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaa

SEQ ID NO: 184 - protein, 208 aa, Homo sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 185 - DNA, 1475 bp, Homo sapiens
ggcacgagggagcggagcctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggaaaaaaaaaaaaaaaaaaaaaa

SEQ ID NO: 186 - protein, 312 aa, Homo sapiens
MAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 187 - DNA, 600 bp, Homo sapiens
atggaagccagagacaagcaggtactccgctccctgcgtctggagctgggtgccgaggtactggtggaaggactggttcttcagtacctttaccaggaaggaattttgacagaaaaccacattcaagaaatcaaagctcaaaccacaggcctccggaagacaatgctgttgctggacatcctgccttccaggggccccaaagcttttgacaccttcctcgattccctccaggaatttccctgggtaagagagaagctggagaaggcgagagaggaagtcacagccgagctgcctacaggtgactggatggccggaatcccctcacacatcctcagcagctcgccatcagaccagcagattaaccagctggctcagaagctaggcccggagtgggagcccgtggtcctgtctctgggactgtcccagaccgacatctaccgctgcaaggccaaccatccccacaacgtgcattcgcaggtggtggaggcctttgtccgctggcgccagcgttttgggaagcaggccaccttcctaagcttacacaagggcctccaggcagtggaggctgatccctccctgctccagcacatgctggagtga

SEQ ID NO: 188 - protein, 199 aa, Homo sapiens [sequence omitted]

SEQ ID NO: 189 - DNA, 1642 bp, Homo sapiens; identical to SEQ ID NO: 183

SEQ ID NO: 190 - protein, 208 aa, Homo sapiens; identical to SEQ ID NO: 184

SEQ ID NO: 191 - DNA, 3492 bp, Homo sapiens
gggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaagcaccgcctccaaatgctaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgaaaaaaaa

SEQ ID NO: 192 - protein, 425 aa, Homo sapiens
GSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 193 - DNA, 1799 bp, Homo sapiens
cccacgcgtccgcataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccttgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacaaaaaaaaaaaaaaaaaaaaaagggcggccgcgactctagagtcgacctgcagaagcttggccgccatggcc

SEQ ID NO: 194 - protein, 411 aa, Homo sapiens [sequence omitted]

SEQ ID NO: 195 - DNA, 683 bp, Homo sapiens
gggctgcaggaattcggcacgagcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaa

SEQ ID NO: 196 - protein, 189 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKVRL

SEQ ID NO: 197 - DNA, 2967 bp, Homo sapiens
tagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagt

SEQ ID NO: 198 - protein, 540 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 199 - DNA, 2531 bp, Homo sapiens
tctaagtagtatcttggaaattcagagagatactcatcctacctgaatataaactgagataaatccagtaaagaaagtgtagtaaattctacataagagtctatcattgatttcttttggtggtaaaaatcttagttcatgtgaagaaatttcatgtgaatgttttagctatcaaacagcactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttctaaatgctgaagatgaaaaaagagaggaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttt

SEQ ID NO: 200 - protein, 618 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 201 - DNA, 2477 bp, Homo sapiens
agtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 202 - protein, 277 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 203 - DNA, 1906 bp, Homo sapiens
agaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggacgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaa

SEQ ID NO: 204 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 205 - DNA, 1090 bp, Homo sapiens
atggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactgctgcatcgtggcactcctctcgcatggtgtggagggcgccatctatggtgtggatgggaaactgctccagctccaagaggtttttcagctctttgacaacgccaaccgcccaagcctacagaacaaaccaaaaatgttcttcatccaggcctgccgtggagatgagactaatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatga

SEQ ID NO: 206 - protein, 91 aa, Homo sapiens
MAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 207 - DNA, 714 bp, Artificial sequence
  Human IgG1 (hinge, CH2 & CH3)
tctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 208 - protein, 235 aa, Artificial sequence
  Human IgG1 (hinge, CH2 & CH3 domains)
SDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - DNA, 718 bp, Artificial sequence
  Fusion polynucleotide
  misc_feature (34)..(34): n = A, T, C or G
  misc_feature (43)..(43): n = A, T, C or G
  misc_feature (52)..(52): n = A, T, C or G
  misc_feature (55)..(55): n = A, T, C or G
  misc_feature (58)..(58): n = A, T, C or G
  misc_feature (64)..(64): n = A, T, C or G
tgatcaagaaccacatggaggatgcacgtgcccncagtgcccncaatgcccngcnccngaactnccaggaggcccttctgtctttgtcttccccccgaaacccaaggacgtcctctccatttttggaggccgagtcacgtgcgttgtagtggacgtcggaaagaaagaccccgaggtcaatttcaactggtatattgatggcgttgaggtgcgaacggccaatacgaagccaaaagaggaacagttcaacagcacgtaccgcgtggtcagcgtcctgcccatccagcaccaggactggctgacggggaaggaattcaagtgcaaggtcaacaacaaagctctcccggcccccatcgagaggaccatctccaaggccaaagggcagacccgggagccgcaggtgtacaccctggccccacaccgggaagaactggccaaggacaccgtgagcgtaacatgcctggtcaaaggcttctacccagctgacatcaacgttgagtggcagaggaacggtcagccggagtcagagggcacctacgccaacacgccgccacagctggacaacgacgggacctacttcctctacagcaagctctcggtgggaaagaacacgtggcagcggggagaaaccttaacctgtgtggtgatgcatgaggccctgcacaaccactacacccagaaatccatcacccagtcttcgggtaaatagtaatctaga

SEQ ID NO: 210 - DNA, 757 bp, Artificial sequence
  Fusion polynucleotide
tgatcaagaacccaagacaccaaaaccacaaccacaaccacaaccacaacccaatcctacaacagaatccaagtgtcccaaatgtccagcccctgagctcctgggagggccctcagtcttcatcttccccccgaaacccaaggacgtcctctccatttctgggaggcccgaggtcacgtgcgttgtggtagacgtgggccaggaagaccccgaggtcagtttcaactggtacattgatggcgctgaggtgcgaacggccaacacgaggccaaaagaggaacagttcaacagcacgtaccgcgtggtcagcgtcctgcccatccagcaccaggactggctgacggggaaggaattcaagtgcaaggtcaacaacaaagctctcccggcccccatcgagaagaccatctccaaggccaaagggcagacccgggagccgcaggtgtacaccctggccccacaccgggaagagctggccaaggacaccgtgagcgtaacatgcctggtcaaaggcttctacccacctgatatcaacgttgagtggcagaggaatgggcagccggagtcagagggcacytacgccaccacgccaccccagctggacaacgacgggacctacttcctctacagcaagctctcggtgggaaagaacacgtggcagcagggagaaaccttcacctgtgtggtgatgcacgaggccctgcacaaccactacacccagaaatccatcacccagtcttcgggtaaatagtaatctaga

SEQ ID NO: 211 - DNA, 727 bp, Artificial sequence
  Fusion polynucleotide
tgatcaagcgcaccacagcgaagaccccagctccaagtgtcccaaatgcccaggccctgaactccttggagggcccacggtcttcatcttccccccgaaagccaaggacgtcctctccatcacccgaaaacctgaggtcacgtgcttgtggtggacgtgggtaaagaagaccctgagatcgagttcaagctggtccgtggatgacacagaggtacacacggctgagacaaagccaaaggaggaacagttcaacagcacgtaccgcgtggtcagcgtcctgcccatccagcaccaggactggctgacggggaaggaattcaagtgcaaggtcaacaacaaagctctcccagcccccatcgagaggaccatctccaaggccaaagggcagacccgggagccgcaggtgtacaccctggccccacaccgggaagagctggccaaggacaccgtgagcgtaacctgcctggtcaaaggcttcttcccagctgacatcaacgttgagtggcagaggaatgggcagccggagtcagagggcacctacgccaacacgccgccacagctggacaacgacgggacctacttcctctacagcaaactctccgtgggaaagaacacgtggcagcagggagaagtcttcacctgtgtggtgatgcacgaggctctacacaatcactccacccagaaatccatcacccagtcttcgggtaaatagtaatctagagggccc

SEQ ID NO: 212 - protein, 231 aa, Artificial sequence
  Fusion polypeptide
EPHGGCTCPQCPAPELPGGPSVFVFPPKPKDVLSISGRPEVTCVVVDVGKEDPEVNFNWYIDGVEVRTANTKPKEEQFNSTYRVVSVLPIQHQDWLTGKEFKCKVNNKALPAPIERTISKAKGQTREPQVYTLAPHREELAKDTVSVTCLVKGFYPADINVEWQRNGQPESEGTYANTPPQLDNDGTYFLYSRLSVGKNTWQRGETLTGVVMHEALHNHYTQKSITQSSGK

SEQ ID NO: 213 - protein, 248 aa, Artificial sequence
  Fusion polypeptide
DQEPKTPKPQPQPQPQPNPTTESKCPKCPAPELLGGPSVFIFPPKPKDVLSISGRPEVTCVVVDVGQEDPEVSFNWYIDGAEVRTANTRPKEEQFNSTYRVVSVLPIQHQDWLTGKEFKCKVNNKALPAPIEKTISKAKGQTREPQVYTLAPHREELAKDTVSVTCLVKGFYPPDINVEWQRNGQPESEGTYATTPPQLDNDGTYFLYSKLSVGKNTWQQGETFTCVVMHEALHNHYTQKSITQSSGK

SEQ ID NO: 214 - protein, 236 aa, Artificial sequence
  Fusion polypeptide
DQAHHSEDPSSKCPKCPGPELLGGPTVFIFPPKAKDVLSITRKPEVTCLWWTWVKKTLRSSSSWSVDDTEVHTAETKPKEEQFNSTYRVVSVLPIQHQDWLTGKEFKCKVNNKALPAPIERTISKAKGQTREPQVYTLAPHREELAKDTVSVTCLVKGFFPADINVEWQRNGQPESEGTYANTPPQLDNDGTYFLYSKLSVGKNTWQQGEVFTCVVMHEALHNHSTQKSITQSSGK

SEQ ID NO: 215 - DNA, 54 bp, Artificial sequence
  Fusion polynucleotide
gatcaggagcccaaatcttgtgacaaaactcacacatgcccaccgtgcccagca

SEQ ID NO: 216 - protein, 18 aa, Artificial sequence
  Fusion polypeptide
DQEPKSCDKTHTCPPCPA

SEQ ID NO: 217 - DNA, 54 bp, Artificial sequence
  Fusion polynucleotide
gatctggagcccaaatcttgtgacaaaactcacacatgcccaccgtgcccagca

SEQ ID NO: 218 - protein, 18 aa, Artificial sequence
  Fusion polypeptide
DLEPKSCDKTHTCPPCPA

SEQ ID NO: 219 - DNA, 327 bp, Artificial sequence
  Fusion polynucleotide
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaa

SEQ ID NO: 220 - protein, 109 aa, Artificial sequence
  Fusion polypeptide
PELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 221 - DNA, 324 bp, Artificial sequence
  Fusion polynucleotide
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 222 - protein, 107 aa, Artificial sequence
  Fusion polypeptide
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - DNA, 54 bp, Artificial sequence
  Fusion polynucleotide
gatcaggagcccaaatcttctgacaaaactcacacatccccaccgtccccagca

SEQ ID NO: 224 - protein, 18 aa, Artificial sequence
  Fusion polypeptide
DQEPKSSDKTHTSPPSPA

SEQ ID NO: 225 - DNA, 712 bp, Artificial sequence
  Fusion polynucleotide
tgatcaccccaaatcttctgacaaaactcacacatctccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataatctaga

SEQ ID NO: 226 - protein, 233 aa, Artificial sequence
  Fusion polypeptide
DHPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - DNA, 35 bp, Artificial sequence
  5' primer for llama IgG1 constant region
gttgttgatcaagaaccacatggaggatgcacgtg

SEQ ID NO: 228 - DNA, 32 bp, Artificial sequence
  5' primer for llama IgG2 constant region
gttgttgatcaagaacccaagacaccaaaacc

SEQ ID NO: 229 - DNA, 33 bp, Artificial sequence
  5' primer for llama IgG3 constant region
gttgttgatcaagcgcaccacagcgaagacccc

SEQ ID NO: 230 - DNA, 19 bp, Artificial sequence
  Llama Fc sense sequencing primer
ctgagatcgagttcagctg

SEQ ID NO: 231 - DNA, 19 bp, Artificial sequence
  Llama Fc antisense sequencing primer
cctcctttggctttgtctc

SEQ ID NO: 232 - DNA, 1527 bp, Artificial sequence
  Fusion polynucleotide
  misc_feature (843)..(843): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (873)..(873): n is a, c, g, or t
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagaaccacatggaggatgcacgtgcccncagtgcccncaatgcccngcnccngaactnccaggaggcccttctgtctttgtcttccccccgaaacccaaggacgtcctctccatttttggaggccgagtcacgtgcgttgtagtggacgtcggaaagaaagaccccgaggtcaatttcaactggtatattgatggcgttgaggtgcgaacggccaatacgaagccaaaagaggaacagttcaacagcacgtaccgcgtggtcagcgtcctgcccatccagcaccaggactggctgacggggaaggaattcaagtgcaaggtcaacaacaaagctctcccggcccccatcgagaggaccatctccaaggccaaagggcagacccgggagccgcaggtgtacaccctggccccacaccgggaagaactggccaaggacaccgtgagcgtaacatgcctggtcaaaggcttctacccagctgacatcaacgttgagtggcagaggaacggtcagccggagtcagagggcacctacgccaacacgccgccacagctggacaacgacgggacctacttcctctacagcaagctctcggtgggaaagaacacgtggcagcggggagaaaccttaacctgtgtggtgatgcatgaggccctgcacaaccactacacccagaaatccatcacccagtcttcgggtaaatagtaatctaga

SEQ ID NO: 233 - DNA, 1566 bp, Artificial sequence
  Fusion polynucleotide
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagaacccaagacaccaaaaccacaaccacaaccacaaccacaacccaatcctacaacagaatccaagtgtcccaaatgtccagcccctgagctcctgggagggccctcagtcttcatcttccccccgaaacccaaggacgtcctctccatttctgggaggcccgaggtcacgtgcgttgtggtagacgtgggccaggaagaccccgaggtcagtttcaactggtacattgatggcgctgaggtgcgaacggccaacacgaggccaaaagaggaacagttcaacagcacgtaccgcgtggtcagcgtcctgcccatccagcaccaggactggctgacggggaaggaattcaagtgcaaggtcaacaacaaagctctcccggcccccatcgagaagaccatctccaaggccaaagggcagacccgggagccgcaggtgtacaccctggccccacaccgggaagagctggccaaggacaccgtgagcgtaacatgcctggtcaaaggcttctacccacctgatatcaacgttgagtggcagaggaatgggcagccggagtcagagggcacytacgccaccacgccaccccagctggacaacgacgggacctacttcctctacagcaagctctcggtgggaaagaacacgtggcagcagggagaaaccttcacctgtgtggtgatgcacgaggccctgcacaaccactacacccagaaatccatcacccagtcttcgggtaaatagtaatctaga

SEQ ID NO: 234 - DNA, 1536 bp, Artificial sequence
  Fusion polynucleotide
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagcgaaccacagcgaagaccccagctccaagtgtcccaaatgcccaggccctgaactccttggagggcccacggtcttcatcttccccccgaaagccaaggacgtcctctccatcacccgaaaacctgaggtcacgtgcttgtggtggacgtgggtaaagaagaccctgagatcgagttcaagctggtccgtggatgacacagaggtacacacggctgagacaaagccaaaggaggaacagttcaacagcacgtaccgcgtggtcagcgtcctgcccatccagcaccaggactggctgacggggaaggaattcaagtgcaaggtcaacaacaaagctctcccagcccccatcgagaggaccatctccaaggccaaagggcagacccgggagccgcaggtgtacaccctggccccacaccgggaagagctggccaaggacaccgtgagcgtaacctgcctggtcaaaggcttcttcccagctgacatcaacgttgagtggcagaggaatgggcagccggagtcagagggcacctacgccaacacgccgccacagctggacaacgacgggacctacttcctctacagcaaactctccgtgggaaagaacacgtggcagcagggagaagtcttcacctgtgtggtgatgcacgaggctctacacaatcactccacccagaaatccatcacccagtcttcgggtaaatagtaatctagagggccc

SEQ ID NO: 235 - protein, 498 aa, Artificial sequence
  Fusion polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPHGGCTCPQCPAPELPGGPSVFVFPPKPKDVLSIFGGRVTCVVVDVGKKDPEVNFNWYIDGVEVRTANTKPKEEQFNSTYRVVSVLPIQHQDWLTGKEFKCKVNNKALPAPIERTISKAKGQTREPQVYTLAPHREELAKDTVSVTCLVKGFYPADINVEWQRNGQPESEGTYANTPPQLDNDGTYFLYSKLSVGKNTWQRGETLTCVVMHEALHNHYTQKSITQSSGK

SEQ ID NO: 236 - protein, 514 aa, Artificial sequence
  Fusion polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKTPKPQPQPQPQPNPTTESKCPKCPAPELLGGPSVFIFPPKPKDVLSISGRPEVTCVVVDVGQEDPEVSFNWYIDGAEVRTANTRPKEEQFNSTYRVVSVLPIQHQDWLTGKEFKCKVNNKALPAPIEKTISKAKGQTREPQVYTLAPHREELAKDTVSVTCLVKGFYPPDINVEWQRNGQPESEGTYATTPPQLDNDGTYFLYSKLSVGKNTWQQGETFTCVVMHEALHNHYTQKSITQSSGK

SEQ ID NO: 237 - protein, 503 aa, Artificial sequence
  Fusion polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQAHSHSEDPSSKCPKCPGPELLGGPTVFIFPPKAKDVLSITRKPEVTCLWWTWVKKTLRSSSSWSVDDTEVHTAETKPKEEQFNSTYRVVSVLPIQHQDWLTGKEFKCKVNNKALPAPIERTISKAKGQTREPQVYTLAPHREELAKDTVSVTCLVKGFFPADINVEWQRNGQPESEGTYANTPPQLDNDGTYFLYSKLSVGKNTWQQGEVFTCVVMHEALHNHSTQKSITQSSGK

SEQ ID NO: 238 - DNA, 42 bp, Artificial sequence
  3'-primer for llama IgG1, IgG2, IgG3 constant region
gttgtttctagattactatttacccgaagactgggtgatgga

SEQ ID NO: 239 - DNA, 1521 bp, Artificial sequence
  Fusion polynucleotide
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 240 - protein, 500 aa, Artificial sequence
  Fusion polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - DNA, 162 bp, Artificial sequence
  Transmembrane domain and cytoplasmic tail of human CD80
gcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 242 - protein, 51 aa, Artificial sequence
  Transmembrane domain and cytoplasmic tail of human CD80
ADPSNLLPSWAITLISVNGIFVICCLTYCFAPRCRERRRNERLRRESVRPV

SEQ ID NO: 243 - DNA, 399 bp, Artificial sequence
  VL region nucleotide sequence of 40.2.220
aagcttatggattttcaagtgcagattttcagcttcctgctaatcagtgcttcagtcataatgtccagaggagtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacgg

SEQ ID NO: 244 - protein, 131 aa, Artificial sequence
  VL region pp sequence of 40.2.220
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKR

SEQ ID NO: 245 - DNA, 368 bp, Artificial sequence
  VH region nucleotide sequence of 40.2.220
cagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatca

SEQ ID NO: 246 - protein, 121 aa, Artificial sequence
  VH region pp sequence of 40.2.220
QIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVS

SEQ ID NO: 247 - DNA, 812 bp, Artificial sequence
  40.2.220 scFv
aagcttatggattttcaagtgcagattttcagcttcctgctaatcagtgcttcagtcataatgtccagaggagtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatca

SEQ ID NO: 248 - protein, 267 aa, Artificial sequence
  40.2.220 scFv
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVS

SEQ ID NO: 249 - DNA, 405 bp, Artificial sequence
  VL region nucleotide sequence of 2E12
atggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacgg

SEQ ID NO: 250 - protein, 135 aa, Artificial sequence
  VL region pp sequence of 2E12
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKR

SEQ ID NO: 251 - DNA, 369 bp, Artificial sequence
  VH region nucleotide sequence of 2E12
caggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctg

SEQ ID NO: 252 - protein, 121 aa, Artificial sequence
  VH region pp sequence of 2E12
QVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSS

SEQ ID NO: 253 - DNA, 825 bp, Artificial sequence
  2e12 scFv
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctctgatcag

SEQ ID NO: 254 - protein, 271 aa, Artificial sequence
  2e12 scFv
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSS

SEQ ID NO: 255 - DNA, 393 bp, Artificial sequence
  VL region nucleotide sequence of 10A8
atggattttcaagtgcagattttcagcttcctgctaatcagtgcttcagtcataatgtccagaggagtcgacatccagatgacacagtctccatcctcactgtctgcatctctgggaggcaaagtcaccatcacttgcaaggcaagccaagacattaagaagtatataggttggtaccaacacaagcctggaaaaggtcccaggctgctcatatattacacatctacattacagccaggcatcccatcaaggttcagtggaagtgggtctgggagagattattccctcagcatcagaaacctggagcctgaagatattgcaacttattattgtcaacagtatgataatcttccattgacgttcggctcggggacaaagttggaaataaaacgg

SEQ ID NO: 256 - protein, 131 aa, Artificial sequence
  VL region pp sequence of 10A8
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKR

SEQ ID NO: 257 - DNA, 362 bp, Artificial sequence
  VH region nucleotide sequence of 10A8
gatgtacagcttcaggagtcaggacctggcctcgtgaaaccttctcagtctctgtctctcacctgctctgtcactggctactccatcaccagtggtttctactggaactggatccgacagtttccgggaaacaaactggaatggatgggccacataagccacgacggtaggaataactacaacccatctctcataaatcgaatctccatcactcgtgacacatctaagaaccagtttttcctgaagttgagttctgtgactactgaggacacagctacatatttctgtgcaagacactacggtagtagcggagctatggactactggggtcaaggaacctcagtcaccgtctcctctgatca

SEQ ID NO: 258 - protein, 119 aa, Artificial sequence
  VH region pp sequence of 10A8
DVQLQESGPGLVKPSQSLSLTCSVTGYSITSGFYWNWIRQFPGNKLEWMGHISHDGRNNYNPSLINRISITRDTSKNQFFLKLSSVTTEDTATYFCARHYGSSGAMDYWGQGTSVTVSS

SEQ ID NO: 259 - DNA, 806 bp, Artificial sequence
  10A8 ScFv pn sequence
aagcttatggattttcaagtgcagattttcagcttcctgctaatcagtgcttcagtcataatgtccagaggagtcgacatccagatgacacagtctccatcctcactgtctgcatctctgggaggcaaagtcaccatcacttgcaaggcaagccaagacattaagaagtatataggttggtaccaacacaagcctggaaaaggtcccaggctgctcatatattacacatctacattacagccaggcatcccatcaaggttcagtggaagtgggtctgggagagattattccctcagcatcagaaacctggagcctgaagatattgcaacttattattgtcaacagtatgataatcttccattgacgttcggctcggggacaaagttggaaataaaacggggtggcggtggctcgggcggtggtgggtcgggtggcggcggatctgatgtacagcttcaggagtcaggacctggcctcgtgaaaccttctcagtctctgtctctcacctgctctgtcactggctactccatcaccagtggtttctactggaactggatccgacagtttccgggaaacaaactggaatggatgggccacataagccacgacggtaggaataactacaacccatctctcataaatcgaatctccatcactcgtgacacatctaagaaccagtttttcctgaagttgagttctgtgactactgaggacacagctacatatttctgtgcaagacactacggtagtagcggagctatggactactggggtcaaggaacctcagtcaccgtctcctctgatca

SEQ ID NO: 260 - protein, 266 aa, Artificial sequence
  10A8 scFv
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKRGGGGSGGGGSGGGGSDVQLQESGPGLVKPSQSLSLTCSVTGYSITSGFYWNWIRQFPGNKLEWMGHISHDGRNNYNPSLINRISITRDTSKNQFFLKLSSVTTEDTATYFCARHYGSSGAMDYWGQGTSVTVSSD

SEQ ID NO: 261 - DNA, 417 bp, Artificial sequence
  VH region nucleotide sequence of 500A2
atggcatggagctgcattattttcttcttggtatcagtaattacaggtgtccattcccaggtcaagctgcagcagtccggttctgaactagggaaacctggggcctcagtgaaactgtcctgcaagacttcaggctacatattcacagatcactatatttcttgggtgaaacagaagcctggagaaagcctgcagtggataggaaatgtttatggtggaaatggtggtacaagctacaatcaaaaattccagggcaaggccacactgactgtagataaaatctctagcacagcctacatggaactcagcagcctgacatctgaggattctgccatctattactgtgcaagaaggccggtagcgacgggccatgctatggactactggggtcaggggatccaagttaccgtctcctca

SEQ ID NO: 262 - protein, 139 aa, Artificial sequence
  VH region pp sequence of 500A2
MAWSCIIFFLVSVITGVHSQVKLQQSGSELGKPGASVKLSCKTSGYIFTDHYISWVKQKPGESLQWIGNVYGGNGGTSYNQKFQGKATLTVDKISSTAYMELSSLTSEDSAIYYCARRPVATGHAMDYWGQGIQVTVSS

SEQ ID NO: 263 - DNA, 381 bp, Artificial sequence
  VL region nucleotide sequence of 500A2
atgttgtatacatctcagctccttgggcttttactcttctggatttcagcctccagaagtgacatagtgctgactcagactccagccactctgtctctaattcctggagaaagagtcacaatgacctgtaagaccagtcagaatattggcacaatcttacactggtatcaccaaaaaccaaaggaggctccaagggctctcatcaagtatgcttcgcagtccattcctgggatcccctccagattcagtggcagtggttcggaaacagatttcactctcagcatcaataacctggagcctgatgatatcggaatttattactgtcaacaaagtagaagctggcctgtcacgttcggtcctggcaccaagctggagataaaa

SEQ ID NO: 264 - protein, 127 aa, Artificial sequence
  VL region pp sequence of 500A2
MLYTSQLLGLLLFWISASRSDIVLTQTPATLSLIPGERVTMTCKTSQNIGTILHWYHQKPKEAPRALIKYASQSIPGIPSRFSGSGSETDFTLSINNLEPDDIGIYYCQQSRSWPVTFGPGTKLEIK

SEQ ID NO: 265 - DNA, 1671 bp, Artificial sequence
  40.2.220-ScFv-IgG-CD80 pn sequence
aagcttatggattttcaagtgcagattttcagcttcctgctaatcagtgcttcagtcataatgtccagaggagtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 266 - protein, 552 aa, Artificial sequence
  40.2.220-ScFv-IgG-CD80 pn sequence
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 267 - DNA, 1683 bp, Artificial sequence
  2E12-ScFv-IgG-CD80 pn sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 268 - protein, 556 aa, Artificial sequence
  2E12-ScFv-IgG-CD80 pn sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 269 - DNA, 1665 bp, Artificial sequence
  10A8-ScFv-IgG-CD80 pn sequence
aagcttatggattttcaagtgcagattttcagcttcctgctaatcagtgcttcagtcataatgtccagaggagtcgacatccagatgacacagtctccatcctcactgtctgcatctctgggaggcaaagtcaccatcacttgcaaggcaagccaagacattaagaagtatataggttggtaccaacacaagcctggaaaaggtcccaggctgctcatatattacacatctacattacagccaggcatcccatcaaggttcagtggaagtgggtctgggagagattattccctcagcatcagaaacctggagcctgaagatattgcaacttattattgtcaacagtatgataatcttccattgacgttcggctcggggacaaagttggaaataaaacggggtggcggtggctcgggcggtggtgggtcgggtggcggcggatctgatgtacagcttcaggagtcaggacctggcctcgtgaaaccttctcagtctctgtctctcacctgctctgtcactggctactccatcaccagtggtttctactggaactggatccgacagtttccgggaaacaaactggaatggatgggccacataagccacgacggtaggaataactacaacccatctctcataaatcgaatctccatcactcgtgacacatctaagaaccagtttttcctgaagttgagttctgtgactactgaggacacagctacatatttctgtgcaagacactacggtagtagcggagctatggactactggggtcaaggaacctcagtcaccgtctcctctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 270 - protein, 550 aa, Artificial sequence
  10A8-ScFv-IgG-CD80 pn sequence
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKRGGGGSGGGGSGGGGSDVQLQESGPGLVKPSQSLSLTCSVTGYSITSGFYWNWIRQFPGNKLEWMGHISHDGRNNYNPSLINRISITRDTSKNQFFLKLSSVTTEDTATYFCARHYGSSGAMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 271 - DNA, 1653 bp, Artificial sequence
  500A2-ScFv-IgG-CD80 pn sequence
atgttgtatacatctcagctccttgggcttttactcttctggatttcagcctccagaagtgacatagtgctgactcagactccagccactctgtctctaattcctggagaaagagtcacaatgacctgtaagaccagtcagaatattggcacaatcttacactggtatcaccaaaaaccaaaggaggctccaagggctctcatcaagtatgcttcgcagtccattcctgggatcccctccagattcagtggcagtggttcggaaacagatttcactctcagcatcaataacctggagcctgatgatatcggaatttattactgtcaacaaagtagaagctggcctgtcacgttcggtcctggcaccaagctggagataaaacggggtggcggtggctcgggcggaggtgggtcgggtggcggcggatctcaggtcaagctgcagcagtccggttctgaactagggaaacctggggcctcagtgaaactgtcctgcaagacttcaggctacatattcacagatcactatatttcttgggtgaaacagaagcctggagaaagcctgcagtggataggaaatgtttatggtggaaatggtggtacaagctacaatcaaaaattccagggcaaggccacactgactgtagataaaatctctagcacagcctacatggaactcagcagcctgacatctgaggattctgccatctattactgtgcaagaaggccggtagcgacgggccatgctatggactactggggtcaggggatccaagttaccgtctcctctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 272 - protein, 548 aa, Artificial sequence
  500A2-ScFv-IgG-CD80 pn sequence
MLYTSQLLGLLLFWISASRSDIVLTQTPATLSLIPGERVTMTCKTSQNIGTILHWYHQKPKEAPRALIKYASQSIPGIPSRFSGSGSETDFTLSINNLEPDDIGIYYCQQSRSWPVTFGPGTKLEIKRGGGGSGGGGSGGGGSQVKLQQSGSELGKPGASVKLSCKTSGYIFTDHYISWVKQKPGESLQWIGNVYGGNGGTSYNQKFQGKATLTVDKISSTAYMELSSLTSEDSAIYYCARRPVATGHAMDYWGQGIQVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 273 - DNA, 1521 bp, Artificial sequence
  2H7 ScFv-Ig (capable of binding CD20)
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 274 - protein, 500 aa, Artificial sequence
  2H7 ScFv-Ig (capable of binding CD20)
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - DNA, 64 bp, Artificial sequence
  Oligo to make IgG hinge SSC mutant using IgG hinge SSS as a template
gttgttgatcaggagcccaaatcttctgacaaaactcacacatctccaccgtgcccagcacctg

SEQ ID NO: 276 - DNA, 51 bp, Artificial sequence
  Oligo to make IgG hinge SCS mutant using IgG hinge SSS as a template
gttgttgatcaggagcccaaatcttctgacaaaactcacacatgcccaccg

SEQ ID NO: 277 - DNA, 39 bp, Artificial sequence
  Oligo to make IGG hinge CSS mutant using IgG hinge SSS as a template
gttgttgatcaggagcccaaatcttgtgacaaaactcac

SEQ ID NO: 278 - DNA, 52 bp, Artificial sequence
  3' oligo to amplify constant regions for creating IgG hinge mutants
gttgtttctagatcatttacccggagacagggagaggctcttctgcgtgtag

SEQ ID NO: 279 - DNA, 56 bp, Artificial sequence
  Oligo that mutates VH11 L to S
ggaggtgggagctctcaggcttatctacagcagtctggggctgagtcggtgaggcc

SEQ ID NO: 280 - DNA, 30 bp, Artificial sequence
  3' oligo for amplifying IgG1 constant regions
gtctctagactatcatttacccggagacag

SEQ ID NO: 281 - DNA, 54 bp, Artificial sequence
  5' oligo for first PCR to insert IgA hinge into IgG1 CH2-CH3
ccatctccctcaactccacctaccccatctccctcatgcgcacctgaactcctg

SEQ ID NO: 282 - DNA, 50 bp, Artificial sequence
  5' oligo for second PCR to insert IgA hinge into fused to IgG1 CH2
gttgttgatcagccagttccctcaactccacctaccccatctccccaact

SEQ ID NO: 283 - DNA, 1536 bp, Artificial sequence
  2H7scFv-hIgAH-WThIgG1CH2CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcagccagttccctcaactccacctaccccatctccctcaactccacctaccccatctccctcatgcgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 284 - protein, 505 aa, Artificial sequence
  2H7scFv-hIgAH-WThIgG1CH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - DNA, 1584 bp, Artificial sequence
  2H7scFvIgAHIgACH2CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 286 - protein, 520 aa, Artificial sequence
  2H7scFvIgAHIgACH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 287 - DNA, 775 bp, Artificial sequence
  IgAHIgACH2CH3
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 288 - protein, 254 aa, Artificial sequence
  IgAHIgACH2CH3
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 289 - DNA, 51 bp, Artificial sequence
  huIgA3' primer
gttgtttctagattatcagtagcaggtgccgtccacctccgccatgacaac

SEQ ID NO: 290 - DNA, 429 bp, Artificial sequence
  Fusion polynucleotide
agatctcaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctcagctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatctaga

SEQ ID NO: 291 - protein, 139 aa, Artificial sequence
  Fusion polypeptide
RSQEDERIVLVDNKCKCARITSRIIRSSEDPNEDIVERNIRIIVPLNNRENISDPTSPLRTRFVYHLSDLSCKKCDPTEVELDNQIVTATQSNICDEDSATETCYTYDRNKCYTAVVPLVYGGETKMVETALTPDACYP

SEQ ID NO: 292 - DNA, 36 bp, Artificial sequence
  5' oligo to PCR J chain
gttgttagatctcaagaagatgaaaggattgttctt

SEQ ID NO: 293 - DNA, 36 bp, Artificial sequence
  3' oligo to PCR J chain
gttgtttctagattagtcaggatagcaggcatctgg

SEQ ID NO: 294 - protein, 4 aa, Artificial sequence
  4 carboxy terminal amino acids deleted from IgA CH3
GTCY

SEQ ID NO: 295 - DNA, 763 bp, Artificial sequence; identical to SEQ ID NO: 37
  Fusion polynucleotide

SEQ ID NO: 296 - protein, 250 aa, Artificial sequence
  Fusion polypeptide
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 297 - DNA, 45 bp, Artificial sequence
  3' oligo for construct with 4 amino acid deletion in IgA CH3
gttgtttctagattatcagtccacctccgccatgacaacagacac

SEQ ID NO: 298 - DNA, 1572 bp, Artificial sequence
  2H7hIgAHhIgATC (-4AA)
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 299 - protein, 516 aa, Artificial sequence
  2H7hIgAHhIgA-TC (-4AA) 2H7 IgA fusion protein with the truncated CH3 carboxy end
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 300 - protein, 14 aa, Artificial sequence
  14 amino acids deleted from IgAH-T4 (so that total of 18 amino acids deleted from wild type IgA CH3
PTHVNVSVVMAEVD

SEQ ID NO: 301 - DNA, 45 bp, Artificial sequence
  3' oligo for engineering 14 amino acid from IgA-T4
gttgtttctagattatcatttacccgccaagcggtcgatggtctt

SEQ ID NO: 302 - DNA, 709 bp, Artificial sequence
  2H7 IgAH IgA-T18
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaa

SEQ ID NO: 303 - protein, 236 aa, Artificial sequence
  2H7 IgAH IgA-T18
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGK

SEQ ID NO: 304 - DNA, 1518 bp, Artificial sequence
  2H7 scFv-IgAHiGACH2CH3(T18)
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaa

SEQ ID NO: 305 - protein, 502 aa, Artificial sequence
  2H7 scFv-IgAHIgACH2CH3(T18)
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGK

SEQ ID NO: 306 - DNA, 924 bp, Artificial sequence
  CTLA4IgG1-wTHWTCH2CH3
gcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaacccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 307 - protein, 382 aa, Artificial sequence
  Fusion polypeptide
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - DNA, 453 bp, Artificial sequence
  EC domain CTLA4
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaa

SEQ ID NO: 309 - protein, 151 aa, Artificial sequence
  EC domain CTLA4
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQ

SEQ ID NO: 310 - DNA, 51 bp, Artificial sequence
  5' oligo for engineering 14 amino acids from IgA-T4
gttgttgatcagccagttccctcaactccacctaccccatctccctcaact

SEQ ID NO: 311 - DNA, 75 bp, Artificial sequence
  Fusion polynucleotide
atgggggtactgctcacacagaggacgctgctcagtctggtccttgcactcctgtttccaagcatggcgagcatg

SEQ ID NO: 312 - protein, 22 aa, Artificial sequence
  Fusion polypeptide
MGVLLTQRTLLSLVLALLFPSM

SEQ ID NO: 313 - DNA, 372 bp, Artificial sequence
  Fusion polynucleotide
gcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgacggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattct

SEQ ID NO: 314 - protein, 124 aa, Artificial sequence
  Fusion polypeptide
AMHVAQPAVVLASSRGIASFVCEYASPGKATEVRVTVLRQADSQVTEVCAATYMTGNELTFLDDSICTGTSSGNQVNLTIQGLRAMDTGLYICKVELMYPPPYYLGIGNGTQIYVIDPEPCPDS

SEQ ID NO: 315 - DNA, 1149 bp, Artificial sequence
  CTLA4-IgG MTH (SSS) MTCH2WTCH3
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaacccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 316 - protein, 382 aa, Artificial sequence
  CTLA-4 IgG MTH (SSS) MTCH2WTCH3
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - DNA, 1221 bp, Artificial sequence
  CTLA-4 IgAH IgACH2CH3-FL
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 318 - protein, 403 aa, Artificial sequence
  CTLA-4 IgAH IgACH2CH3-FL
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 319 - DNA, 1209 bp, Artificial sequence
  CTLA-4 IgAH IgACH2CH3-T4
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 320 - protein, 399 aa, Artificial sequence
  CTLA-4 IgAH IgACH2CH3-T4
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 321 - DNA, 328 bp, Artificial sequence
  Fusion polynucleotide
cctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaag

SEQ ID NO: 322 - protein, 109 aa, Artificial sequence
  Fusion polypeptide
PELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 323 - protein, 10 aa, Artificial sequence
  Amino acids surrounding the proline at 238
PAPELLGGPS

SEQ ID NO: 324 - protein, 10 aa, Artificial sequence
  Amino acid substitution of Serine for Proline at 238
PAPELLGGSS

SEQ ID NO: 325 - DNA, 35 bp, Artificial sequence
  5' oligo to PCR IgE Fc
gttgttgatcacgtctgctccagggacttcacccc

SEQ ID NO: 326 - DNA, 49 bp, Artificial sequence
  3' oligo to PCR IgE Fc
gttgtttctagattaacttttaccgggatttacagacaccgctcgctgg

SEQ ID NO: 327 - DNA, 51 bp, Artificial sequence
  Oligo to provide open reading frame at carboxy end of CH4 to read into transmembrane and cytoplasmic tail of another protein
gttgttttcgaaggatccgctttaccgggatttacagacaccgctcgctgg

SEQ ID NO: 328 - DNA, 996 bp, Artificial sequence
  Fusion polynucleotide
tgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaa

SEQ ID NO: 329 - protein, 331 aa, Artificial sequence
  Human IgE Fc with ORF 3'
DHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGKADPS

SEQ ID NO: 330 - DNA, 63 bp, Artificial sequence
  Fusion polynucleotides
gttgtttgatcaggagcccaaatcttgtgacaaaactcacacatgcccaccgtgcccagcacc

SEQ ID NO: 331 - DNA, 52 bp, Artificial sequence; identical to SEQ ID NO: 278
  Fusion polynucleotides

SEQ ID NO: 332 - DNA, 91 bp, Artificial sequence
  Fusion polynucleotides
gttgttgatcaggagcccaaatcttctgacaaaactcacacatctccaccgtccccagcacctgaactcctgggtggaccgtcagtcttcc

SEQ ID NO: 333 - DNA, 1800 bp, Artificial sequence
  2H7 scFv-human IgE Fc
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 334 - protein, 592 aa, Artificial sequence
  2H7 scFv-human IgE Fc
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 335 - DNA, 339 bp, Artificial sequence
  VH region-1D8 anti-mouse 4-1BB
caggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctct

SEQ ID NO: 336 - DNA, 321 bp, Artificial sequence
  VL region-1D8 anti-mouse 4-1BB
gacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacgg

SEQ ID NO: 337 - DNA, 785 bp, Artificial sequence
  1D8 anti-mouse 4-1 BB scFv
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatca

SEQ ID NO: 338 - DNA, 1491 bp, Artificial sequence
  1D8 scFvhIgG1-WTHWTCH2CH3
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 339 - DNA, 1585 bp, Artificial sequence
  Fusion polynucleotide
atgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacaagcccaccgagcccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 340 - DNA, 1645 bp, Artificial sequence
  1D8 (anti-murine 40-1BB) scFv IgG WTH WTCH2CH3-CD80
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 341 - protein, 113 aa, Artificial sequence
  VH region-1D8 anti-mouse 4-1BB
QVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSS

SEQ ID NO: 342 - protein, 107 aa, Artificial sequence
  VL region-1D8 anti-mouse 4-1BB
DIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKR

SEQ ID NO: 343 - protein, 258 aa, Artificial sequence
  1D8 anti-mouse 4-1BB scFv
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSS

SEQ ID NO: 344 - protein, 492 aa, Artificial sequence
  1D8 scFvhIgG1-WTHWTCH2CH3
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 543 aa, Artificial sequence
  1D8 (anti-murine 4-1BB) scFv IgG WTH WTCH2CH3-CD80
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 346 - protein, 543 aa, Artificial sequence
  1D8 (anti-murine 4-1BB) scFv IgG MH (SSS) MCH2-WTCH3-CD80
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 347 - DNA, 1527 bp, Artificial sequence
  G19-4 (anti-human CD3) scFv-hIgG1WTHWTCH2WTCH3
aagcttatggattttcaagtgcagattttcagcttcctgctaatcagtgcttcagtcataatgtccagaggagtcgacatccagatgacacagactacatcctccctgtctgcctctctgggagacagagtcaccatcagttgcagggcaagtcaggacattcgcaattatttaaactggtatcagcagaaaccagatggaactgttaaactcctgatctactacacatcaagattacactcaggagtcccatcaaggttcagtggcagtgggtctggaacagattattctctcaccattgccaacctgcaaccagaagatattgccacttacttttgccaacagggtaatacgcttccgtggacgttcggtggaggcaccaaactggtaaccaaacgggagctcggtggcggtggctcgggcggtggtgggtcgggtggcggcggatctatcgatgaggtccagctgcaacagtctggacctgaactggtgaagcctggagcttcaatgtcctgcaaggcctctggttactcattcactggctacatcgtgaactggctgaagcagagccatggaaagaaccttgagtggattggacttattaatccatacaaaggtcttactacctacaaccagaaattcaagggcaaggccacattaactgtagacaagtcatccagcacagcctacatggagctcctcagtctgacatctgaagactctgcagtctattactgtgcaagatctgggtactatggtgactcggactggtacttcgatgtctggggcgcagggaccacggtcaccgtctcctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 348 - protein, 504 aa, Artificial sequence
  G19-4 (anti-human CD3) scFv-hIgG1WTHWTCH2WTCH3
MDFQVQIFSFLLISASVIMSRGVDIQMTQTTSSLSASLGDRVTISCRASQDIRNYLNWYQQKPDGTVKLLIYYTSRLHSGVPSRFSGSGSGTDYSLTIANLQPEDIATYFCQQGNTLPWTFGGGTKLVTKRELGGGGSGGGGSGGGGSIDEVQLQQSGPELVKPGASMSCKASGYSFTGYIVNWLKQSHGKNLEWIGLINPYKGLTTYNQKFKGKATLTVDKSSSTAYMELLSLTSEDSAVYYCARSGYYGDSDWYFDVWGAGTTVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - DNA, 2325 bp, Artificial sequence
  anti-CD20-anti-CD40 scFv IgG MTH (SSS) MTCH2WTCH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaatccaactctgaagaagcaaagaaagaggaggccaaaaaggaggaagccaagaaatctaacagcgtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatcaggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 350 - protein, 768 aa, Artificial sequence
  anti-CD20-anti-CD40 scFv IgG MTH (SSS) MTCH2WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQSNSEEAKKEEAKKEEAKKSNSVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - DNA, 1521 bp, Artificial sequence
  L6 scFv hIgG1 MH (SSS) MCH2 WT CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 352 - protein, 500 aa, Artificial sequence
  L6 scFv hIgG1 MH (SSS) MCH2 WT CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - DNA, 423 bp, Artificial sequence
  5B9-anti-human 4-1BB VH with leader
atggctgtcttggggctgctcttctgcctggtgacatttccaagctgtgtcctatcccaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctca

SEQ ID NO: 354 - DNA, 366 bp, Artificial sequence
  5B9-anti-human 4-1BB VH
caggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctca

SEQ ID NO: 355 - DNA, 399 bp, Artificial sequence
  5B9-anti-human 4-1BB VL
atgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacgg

SEQ ID NO: 356 - DNA, 825 bp, Artificial sequence
  5B9-anti-human 4-1BB scFv
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctct

SEQ ID NO: 357 - DNA, 1536 bp, Artificial sequence
  5B9 scFv IgG MTH (SSS) WTCH2CH3
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 358 - DNA, 1696 bp, Artificial sequence
  5B9-anti-human 4-1BB scFvhIgG1 MH (SSS) MCH2 WTCH3-CD80
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatctggagcccaaatcttctgacaaaactcacacaagcccaccgagcccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatactcgag

SEQ ID NO: 359 - protein, 141 aa, Artificial sequence
  5B9-anti-human 4-1BB VH with leader
MAVLGLLFCLVTFPSCVLSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 360 - protein, 122 aa, Artificial sequence
  5B9-anti-human 401BB VH
QVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 361 - protein, 133 aa, Artificial sequence
  5B9-anti-human 4-1BB VL
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKR

SEQ ID NO: 362 - protein, 271 aa, Artificial sequence
  5B9-anti-human 4-1BB scFv
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 363 - protein, 505 aa, Artificial sequence
  5B9 scFv IgG MTH (SSS) WTCH2CH3
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 364 - protein, 556 aa, Artificial sequence
  5B9-anti-human 4-1BB scFvhIgG1 MH (SSS) MCH2 WTCH3-CD80
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 365 - DNA, 72 bp, Artificial sequence
  3' oligo CH3 mutant F405Y
gttgttgaagacgttcccctgctgccacctgctcttgtccacggtgagcttgctgtagaggtagaaggagcc

SEQ ID NO: 366 - DNA, 72 bp, Artificial sequence
  3' oligo CH3 mutant F405A
gttgttgaagacgttcccctgctgccacctgctcttgtccacggtgagcttgctgtagagggcgaaggagcc

SEQ ID NO: 367 - DNA, 72 bp, Artificial sequence
  3' oligo CH3 mutant Y407A
gttgttgaagacgttcccctgctgccacctgctcttgtccacggtgagcttgctggcgaggaagaaggagcc

SEQ ID NO: 368 - DNA, 72 bp, Artificial sequence
  3' oligo CH3 mutant F405Y and Y407A
gttgttgaagacgttcccctgctgccacctgctcttgtccacggtgagcttgctggcgaggtagaaggagcc

SEQ ID NO: 369 - DNA, 72 bp, Artificial sequence
  3' oligo CH3 mutant F405A and Y407A
gttgttgaagacgttcccctgctgccacctgctcttgtccacggtgagcttgctggcgagggcgaaggagcc

SEQ ID NO: 370 - DNA, 324 bp, Artificial sequence
  Y405 (F405Y)
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 371 - DNA, 324 bp, Artificial sequence
  MTCH3 F405A
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 372 - DNA, 324 bp, Artificial sequence
  A407 (Y407A)
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 373 - DNA, 324 bp, Artificial sequence
  MTCH3 Y405A407
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 374 - DNA, 324 bp, Artificial sequence
  MTCH3 A405A407
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 375 - protein, 107 aa, Artificial sequence
  Y405 (F405Y)
GQPREPQVYTLPPSREEMTKNQVSLTCLVKGFYPSDIAVEWESNGQPENNYKTTPPVLDSDGSFYLYSKLTVDKSRWQQGNVFSCSVMHEALHNHYTQKSLSLSPGK

SEQ ID NO: 376 - protein, 107 aa, Artificial sequence
  MTCH3 F405A
GQPREPQVYTLPPSREEMTKNQVSLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 377 - protein, 107 aa, Artificial sequence
  A407 (Y407A)
GQPREPQVYTLPPSREEMTKNQVSLTCLVKGFYPSDIAVEWESNGQPENNYKTTPPVLDSDGSFFLASKLTVDKSRWQQGNVFSCSVMHEALHNHYTQKSLSLSPGK

SEQ ID NO: 378 - protein, 107 aa, Artificial sequence
  MTCH3 Y405A407
GQPREPQVYTLPPSREEMTKNQVSLTCLVKGFYPSDIAVEWESNGQPENNYKTTPPVLDSDGSFYLASKLTVDKSRWQQGNVFSCSVMHEALHNHYTQKSLSLSPGK

SEQ ID NO: 379 - protein, 107 aa, Artificial sequence
  MTCH3 A405A407
GQPREPQVYTLPPSREEMTKNQVSLTCLVKGFYPSDIAVEWESNGQPENNYKTTPPVLDSDGSFALASKLTVDKSRWQQGNVFSCSVMHEALHNHYTQKSLSLSPGK

SEQ ID NO: 380 - DNA, 1515 bp, Artificial sequence
  2H7 scFvIg (SSS) H WTCH2 MCH3 F405A
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 381 - DNA, 1521 bp, Artificial sequence
  2H7 scFvIg (SSS) H WTCH2 MCH3 F405Y
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctctatagcaagctcaccgtggacaagagcaggtggcagcaggggaacgtcttctcatgctccgtgatgcatgaggctctgcacaaccactacacgcagaagagcctctccctgtccccgggtaaatgatctaga

SEQ ID NO: 382 - DNA, 1515 bp, Artificial sequence
  2H7 scFvIg (SSS) H WTCH2 MCH3 F405Y Y407A
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 383 - DNA, 1515 bp, Artificial sequence
  2H7 scFvIg (SSS) H WTCH2 MCH3 Y407A
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 384 - DNA, 1515 bp, Artificial sequence
  2H7 scFvIg (SSS) H WTCH2 MCH3 F405A Y407A
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 385 - protein, 500 aa, Artificial sequence
  2H7 scFvIg (SSS)H WTCH2 MCH3 F405A
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 386 - protein, 500 aa, Artificial sequence
  2H7 scFvIg (SSS)H WTCH2 MCH3 F405Y
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFYLYSKLTVDKSRWQQGNVFSCSVMHEALHNHYTQKSLSLSPGK

SEQ ID NO: 387 - protein, 500 aa, Artificial sequence
  2H7 scFvIg (SSS)H WTCH2 MCH3 Y407A
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLASKLTVDKSRWQQGNVFSCSVMHEALHNHYTQKSLSLSPGK

SEQ ID NO: 388 - protein, 500 aa, Artificial sequence
  2H7 scFvIg (SSS) H WTCH2 MCH3 F405Y Y407A
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFYLASKLTVDKSRWQQGNVFSCSVMHEALHNHYTQKSLSLSPGK

SEQ ID NO: 389 - protein, 500 aa, Artificial sequence
  2H7 scFvIg (SSS) H WTCH2 MCH3 F405A Y407A
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFALASKLTVDKSRWQQGNVFSCSVMHEALHNHYTQKSLSLSPGK

SEQ ID NO: 390 - DNA, 44 bp, Artificial sequence
  5' oligo to mutate IgG1
gttgttgatcaggagcccaaatcttctgacaaaactcacacatg

SEQ ID NO: 391 - DNA, 54 bp, Artificial sequence
  5' oligo to mutate IgG1
gttgttgatcaggagcccaaatcttgtgacaaaactcacacatctccaccgtgc

SEQ ID NO: 392 - DNA, 63 bp, Artificial sequence
  5' oligo to mutate IgG1
gttgttgatcaggagcccaaatcttgtgacaaaactcacacatgtccaccgtccccagcacct

SEQ ID NO: 393 - DNA, 1521 bp, Artificial sequence
  2H7 scFvIgG1 (SCC)H WTCH2 WTCH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 394 - DNA, 1521 bp, Artificial sequence
  2H7 scFvIgG1 (CSC)H WTCH2 WTCH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatctccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 395 - DNA, 1521 bp, Artificial sequence
  2H7 scFvIgG1 (CCS) H WTCH2 WTCH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatgtccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 396 - protein, 500 aa, Artificial sequence
  2H7 scFvIgG1 (SCC)H WTCH2 WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 500 aa, Artificial sequence
  2H7 scFvIgG1 (CSC)H WTCH2 WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 398 - protein, 500 aa, Artificial sequence
  2H7 scFvIgG1 (CCS)H WTCH2 WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTCPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - DNA, 793 bp, Artificial sequence
  500A2 anti-mouse CD3 scFv
atgttgtatacatctcagctccttgggcttttactcttctggatttcagcctccagaagtgacatagtgctgactcagactccagccactctgtctctaattcctggagaaagagtcacaatgacctgtaagaccagtcagaatattggcacaatcttacactggtatcaccaaaaaccaaaggaggctccaagggctctcatcaagtatgcttcgcagtccattcctgggatcccctccagattcagtggcagtggttcggaaacagatttcactctcagcatcaataacctggagcctgatgatatcggaatttattactgtcaacaaagtagaagctggcctgtcacgttcggtcctggcaccaagctggagataaaacggggtggcggtggctcgggcggaggtgggtcgggtggcggcggatctcaggtcaagctgcagcagtccggttctgaactagggaaacctggggcctcagtgaaactgtcctgcaagacttcaggctacatattcacagatcactatatttcttgggtgaaacagaagcctggagaaagcctgcagtggataggaaatgtttatggtggaaatggtggtacaagctacaatcaaaaattccagggcaaggccacactgactgtagataaaatctctagcacagcctacatggaactcagcagcctgacatctgaggattctgccatctattactgtgcaagaaggccggtagcgacgggccatgctatggactactggggtcaggggatccaagttaccgtctcctctgatc

SEQ ID NO: 400 - protein, 264 aa, Artificial sequence
  500A2 anti-mouse CD3 scFv
MLYTSQLLGLLLFWISASRSDIVLTQTPATLSLIPGERVTMTCKTSQNIGTILHWYHQKPKEAPRALIKYASQSIPGIPSRFSGSGSETDFTLSINNLEPDDIGIYYCQQSRSWPVTFGPGTKLEIKRGGGGSGGGGSGGGGSQVKLQQSGSELGKPGASVKLSCKTSGYIFTDHYISWVKQKPGESLQWIGNVYGGNGGTSYNQKFQGKATLTVDKISSTAYMELSSLTSEDSAIYYCARRPVATGHAMDYWGQGIQVTVSSD

SEQ ID NO: 401 - DNA, 36 bp, Artificial sequence
  Oligonucleotide primer
gttgttgatcagccagttccctcaactccacctacc

SEQ ID NO: 402 - DNA, 44 bp, Artificial sequence
  Oligonucleotide primer
gttgttttcgaaggatccgcgtccacctccgccatgacaacaga

SEQ ID NO: 403 - DNA, 47 bp, Artificial sequence
  Oligonucleotide primer
gttgttttcgaaggatccgctttacccggagacagggagaggctctt

SEQ ID NO: 404 - DNA, 45 bp, Artificial sequence
  Oligonucleotide primer
gttgttagatctggagcccaaatcttgtgacaaaactcacacatg

SEQ ID NO: 405 - DNA, 48 bp, Artificial sequence
  Oligonucleotide primer
gttgtggatccttcgaacccgttcctggtgctgctgcactcggtgtcg

SEQ ID NO: 406 - DNA, 48 bp, Artificial sequence
  Oligonucleotide
gttgttatcgatctcgagttatcaggacgcttcggaggtagatgcgtc

SEQ ID NO: 407 - DNA, 657 bp, Artificial sequence
  Fusion polynucleotide
gtggatccttcgaacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgataactcgagatcgataacaac

SEQ ID NO: 408 - protein, 211 aa, Artificial sequence
  Fusion polypeptide
VDPSNPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 409 - DNA, 60 bp, Artificial sequence
  Oligonucleotide
gttgtggatcctcccttttgggtgctggtggtggttggtgtcctggcttgctatagcttg

SEQ ID NO: 410 - DNA, 60 bp, Artificial sequence
  Oligonucleotide
gttgtttcgaacccagaaaataataaaggccactgttactagcaagctatagcaagccag

SEQ ID NO: 411 - DNA, 32 bp, Artificial sequence
  Oligonucleotide
gttgtggatcctcccttttgggtgctggtggt

SEQ ID NO: 412 - DNA, 33 bp, Artificial sequence
  Oligonucleotide
gttgtttcgaacccagaaaataataaaggccac

SEQ ID NO: 413 - DNA, 28 bp, Artificial sequence
  OIigonucleotide
gttgtggatcctcctgctcccatcctgg

SEQ ID NO: 414 - DNA, 32 bp, Artificial sequence
  Oligonucleotide
gttgtttcgaacggcaaagcagtaggtcaggc

SEQ ID NO: 415 - DNA, 45 bp, Artificial sequence
  Oligonucleotide
gttgtggatccttcgaacccattcctggtgctgctgcactcgctg

SEQ ID NO: 416 - DNA, 42 bp, Artificial sequence
  Oligonucleotide
gttgttatcgatctcgagtcagggtgtttctgaggaagacac

SEQ ID NO: 417 - DNA, 645 bp, Artificial sequence
  Fusion polynucleotide
gtggatccttcgaacatggacccattcctggtgctgctgcactcgctgtccggcagcctgtcgggcaacgatctgatggagctcaagttcttgtgccgcgagcgcgtgagcaaacgaaagctggagcgcgtgcagagtggcctggacctgttcacggtgctgctggagcagaacgacctggagcgcgggcacaccgggctgctgcgcgagttgctggcctcgctgcgccgacacgatctactgcagcgcctggacgacttcgaggcggggacggcgaccgctgcgcccccgggggaggcagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggtcaaggcgctgcggacctgcaggctgaatctggtggctgacctggtggaagaagcccaggaatctgtgagcaagagtgagaatatgtccccagtactaagggattcaactgtgtcttcctcagaaacaccctgactcgagatcgat

SEQ ID NO: 418 - protein, 210 aa, Artificial sequence
  Fusion polypeptide
VDPSNMDPFLVLLHSLSGSLSGNDLMELKFLCRERVSKRKLERVQSGLDLFTVLLEQNDLERGHTGLLRELLASLRRHDLLQRLDDFEAGTATAAPPGEADLQVAFDIVCDNVGRDWKRLARELKVSEAKMDGIEEKYPRSLSERVRESLKVWKNAEKKNASVAGLVKALRTCRLNLVADLVEEAQESVSKSENMSPVLRDSTVSSSETP

SEQ ID NO: 419 - DNA, 48 bp, Artificial sequence
  Oligonucleotide
gttgtggatccttcgaacatggagaacaacaaaacctcagtggattca

SEQ ID NO: 420 - DNA, 44 bp, Artificial sequence
  Oligonucleotide
gttgttatcgatctcgagctagtgataaaagtacagttctttcg

SEQ ID NO: 421 - DNA, 46 bp, Artificial sequence
  Oligonucleotide
gttgtttcgaacatggatttccagagttgtctttatgctattgctg

SEQ ID NO: 422 - DNA, 48 bp, Artificial sequence
  Oligonucleotide
gttgttatcgatctcgagtcattagggagggaagaagagcttcttccg

SEQ ID NO: 423 - DNA, 45 bp, Artificial sequence
  OIigonucleotide
gttgtggatccttcgaacatggagaacactgaaaactcagtggat

SEQ ID NO: 424 - DNA, 48 bp, Artificial sequence
  Oligonucleotide
gttgttatcgatctcgagttagtgataaaaatagagttcttttgtgag

SEQ ID NO: 425 - DNA, 45 bp, Artificial sequence
  Oligonucleotide
gttgtggatccttcgaacatggacttcagcagaaatctttatgat

SEQ ID NO: 426 - DNA, 48 bp, Artificial sequence
  Oligonucleotide
gttgttatcgatgcatgctcaatcagaagggaagacaagtttttttct

SEQ ID NO: 427 - DNA, 714 bp, Artificial sequence; identical to SEQ ID NO: 207
  Human IgG1 WT Fc (hinge, CH2, CH3)

SEQ ID NO: 428 - protein, 234 aa, Artificial sequence
  HuIgG1 WT hinge, CH2, CH3
SDQEPKSCDKTHTCPPCPAPELLGGPSVFLFPPKPKDTLMISRTPEVTCVVVDVSHEDPEVKTHWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 429 - DNA, 718 bp, Llama; identical to SEQ ID NO: 209
  misc_feature (34)..(34): n is a, c, g, or t
  misc_feature (43)..(43): n is a, c, g, or t
  misc_feature (52)..(52): n is a, c, g, or t
  misc_feature (55)..(55): n is a, c, g, or t
  misc_feature (58)..(58): n is a, c, g, or t
  misc_feature (64)..(64): n is a, c, g, or t

SEQ ID NO: 430 - protein, 230 aa, Llama
EPHGGCTCPQCPAPELPGGPSVFVTBPKPKDVLSISGRPEVTCVVVDVGKEDPEVNFHWYIDGVEVRTANTKPKEEQFNSTYRVVSVLPIQHQDWLTGKETKCKVNNKALPAPIERTISKAKGQTREPQVYTLAPHREELAKDTVSVTCLVKGFYPADINVEWQMGQPESEGTYANTPPQLDNDGTYFLYSRLSVGKNTWQRGCTLTGVVMHEALHNHYTQKSITQSSGK

SEQ ID NO: 431 - DNA, 757 bp, Llama; identical to SEQ ID NO: 210

SEQ ID NO: 432 - protein, 247 aa, Llama
DQEPKTPKPQPQPQPQPNPTTESKCPKCPAPELLGGPSVFIFPPKPKDVLSISGRPEVTCVVVDVGQEDPEVSFHWYIDGAEVRTANTRPKEEQFNSTYRVVSVLPIQHQDWLTGKEFKCKVNNKALPAPIEKTISKAKGQTREPQVYTLAPHREELAKDTVSVTCLVKGFYPPDINVEWQMGQPESEGTYATTPPQLDNDGTYFLYSKLSVGKNTWQQGCTFTCVVMHEALHNHYTQKSITQSSGK

SEQ ID NO: 433 - DNA, 727 bp, Llama; identical to SEQ ID NO: 211

SEQ ID NO: 434 - protein, 236 aa, Llama
DQAHHSEDPSSKEPKCPGPELLGGPTVFIFPPKAKDVLSITRKPEVTCLWWTWVKKTLRSSSSWSVDDTEVHTAETKPKEEQFHSTYRVVSVLPIQHQDWLTGKEFKEKVNNKALPAPIERTISKAKGQTREPQVYTLAPHREELAKDTVSVTELVKGFFPADINVEWQRNGQPESEGTYANTPPQLDNDGTYFLYSKLSVGKNTWQQGEVFTCVVMHEALHNHSTQKSITQSSGK

SEQ ID NO: 435 - DNA, 54 bp, Artificial sequence; identical to SEQ ID NO: 215
  HuIgG1 wild type hinge

SEQ ID NO: 436 - protein, 18 aa, Artificial sequence
  HuIgG1 wild type hinge
DQEPKSCDKTHTCPPEPA

SEQ ID NO: 437 - DNA, 54 bp, Artificial sequence
  HuIgG1 H2
gatctggagcccaaatcttgtgacaaaactcacccatgcccaccgtgcccagca

SEQ ID NO: 438 - protein, 18 aa, Artificial sequence
  HuIgG1 H2
DLEPKSEDKTHTCPPCPA

SEQ ID NO: 439 - DNA, 327 bp, Artificial sequence; identical to SEQ ID NO: 219
  HuIgG1 wild type CH2

SEQ ID NO: 440 - protein, 109 aa, Artificial sequence
  HuIgG1 wild type CH2
PELLGGPSVFLFPPKPKDTLMISRTPEVTCVVVDVSHEDPEVKTHWYVDGVEVHNAKTKPREEQYNSTYRVVSVLTVLHQDWLNGKEYKCKVSNKALPAPIEKTISKAK

SEQ ID NO: 441 - DNA, 324 bp, Artificial sequence
  HuIgG1 wild type CH3
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgaaggctccttattcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 442 - protein, 107 aa, Artificial sequence; identical to SEQ ID NO: 222
  HuIgG1 wild type CH3

SEQ ID NO: 443 - DNA, 54 bp, Artificial sequence; identical to SEQ ID NO: 223
  HuIgG1 mutated hinge (SSS)

SEQ ID NO: 444 - protein, 18 aa, Artificial sequence
  HuIgG1 mutated hinge (SSS)
DQEPKSSDKTHTSPPSPA

SEQ ID NO: 445 - DNA, 711 bp, Artificial sequence
  HuIgG1MTH WTCH2CH3
tgatcaccccaaatcttctgacaaaactcacacatctccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggagtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctcctcttcctctacagcaagctcaccgtggacaagagcaggtggcagcaggggaacgtcttctcatgctccgtgatgcatgaggctctgcacaaccactacacgcagaagagcctctccctgtctccgggtaaatgataatctaga

SEQ ID NO: 446 - protein, 235 aa, Artificial sequence
  HuIgG1MTH WTCH2CH3
DHPKSSDKTHTSPPSSAPELLGGPSVFLFPPKPKDTLMISRTPEVTCVVVDVSHEDPEVKTHWYVDGVEVHNAKTKPREEQYNSTYRVVSVLTVLHQDWLNGKEYKEKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGFLVFSESVMHEALHFLHYTQKSLSLSPGK

SEQ ID NO: 447 - DNA, 35 bp, Artificial sequence; identical to SEQ ID NO: 227
  primer

SEQ ID NO: 448 - DNA, 32 bp, Artificial sequence; identical to SEQ ID NO: 228
  primer

SEQ ID NO: 449 - DNA, 33 bp, Artificial sequence; identical to SEQ ID NO: 229
  primer

SEQ ID NO: 450 - DNA, 19 bp, Artificial sequence
  primer
ctgagatcgagttcagctg

SEQ ID NO: 451 - DNA, 19 bp, Artificial sequence
  primer
cctcctttggctttgtctc

SEQ ID NO: 452 - DNA, 1527 bp, Llama
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagaaccacatggaggatgcacgtgcctccagtgcccncaatgcccngcnccngaactcccaggaggcccttctgtctttgtcttccccccgaaacccaaggacgtcctctccatttttggaggccgagtcacgtgcgttgtagtggacgtcggaaagaaagaccccgaggtcaatttcaactggtatattgatggcgttgaggtgcgaacggccaatacgaagccaaaagaggaacagttcaacagcacgtaccgcgtggtcagcgtcctgcccatccagcaccaggactggctgacggggaaggaattcaagtgcaaggtcaacaacaaagctctcccggcccccatcgagaggaccatctccaaggccaaagggcagacccgggagccgcaggtgtacaccctggccccacaccgggaagaactggccaaggacaccgtgagcgtaacatgcctggtcaaaggcttctacccagctgacatcaacgttgagtggcagaggaacggtcagccggagtcagagggcacctacgccaacacgccgccacagctggacaacgacgggacctacttcctctacagcaagctctcggtgggaaagaacacgtggcagcggggagaaaccttaacctgtgtggtgatgcatgaggccctgcacaaccactacacccagaaatccatcacccagtcttcgggtaaatagtaatctaga

SEQ ID NO: 453 - protein, 504 aa, Llama
MDFQVQIFSFLLISASVLLARGQIVLSQSPAILSASPGEKVTMTCRASSSVSYMHWYQQKPGSSPKPWIYAPSNLASGVPARFSGSGSGTSYSLTISRVEAEDAATYYCQQWSFHPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPHGGCTCPQCPAPELPGGPSVLVFPPKPKDVLSIFGGLWTCVVVDVGKKDPEVNFNWYIDGVEVRTANTKPKEEQTHSTYRVVSVLPIQHQDWLTGKETKCKVNFLKALPAPIERTISKAKGQTREPQVYTLAPHREELAKDTVSVTCLVKGFYPADINVEWQRFLGQPESEGTYAFLTPPQLDFLDGTYFLYSKLASVGKFLTWQRGCTLTCVVMHEALHNHYTQKSITQSSGK

SEQ ID NO: 454 - DNA, 1567 bp, Llama
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagaacccaagacaccaaaaccacaaccacaaccacaaccacaacccaatcctacaacagaatccaagtgtcccaaatgtccagcccctgagctcctgggagggccctcagtcttcatcttccccccgaaacccaaggacgtcctctccatttcctgggaggcccgaggtcacgtgcgttgtggtagacgtgggccaggaagaccccgaggtcagtttcaactggtacattgatggcgctgaggtgcgaacggccaacacgaggccaaaagaggaacagttcaacagcacgtaccgcgtggtcagcgtcctgcccatccagcaccaggactggctgacggggaaggaattcaagtgcaaggtcaacaacaaagctctcccggcccccatcgagaagaccatctccaaggccaaagggcagacccgggagccgcaggtgtacaccctggccccacaccgggaagagctggccaaggacaccgtgagcgtaacatgcctggtcaaaggcttctacccacctgatatcaacgttgagtggcagaggaatgggcagccggagtcagagggcacytacgccaccacgccaccccagctggacaacgacgggacctacttcctctacagcaagctctcggtgggaaagaacacgtggcagcagggagaaaccttcacctgtgtggtgatgcacgaggccctgcacaaccactacacccagaaatccatcacccagtcttcgggtaaatagtaatctaga

SEQ ID NO: 455 - protein, 514 aa, Llama
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKTKGKATLTVDKSSSTAYMQLSSLTSEDSAVYFCARVVYYSNSYWYFDVWGTGTTVTVSSDQEPKTPKPQPQPQPQPNPTTESKCPKCPAPELLGGPSVFIFPPKPKDVLSISGRPEVTCVVVDVGQEDPEVSFNWYIDGAEVRTANTRPKEEQFFISTYRVVSVLPIQHQDWLTGKEFKCKVNNKALPAPIEKTISKAKGQTREPQVYTLAPHREELAKDTVSVTCLVKGFYPPDINVEWQMGQPESEGTYATTPPQLDNDGTYFLYSKLSVGKNTWQQGCTFTCVVMHEALHNHYTQKSITQSSGK

SEQ ID NO: 456 - DNA, 1536 bp, Llama; identical to SEQ ID NO: 234

SEQ ID NO: 457 - protein, 503 aa, Llama
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQAHSHSEDPSSKCPKCPGPELLGGPTVFIFPPKAKDVLSITRKPEVTCLWWTWVKKTLRSSSSWSVDDTEVHTAETKPKEEQTHSTYRVVSVLPIQHQDWLTGKEFKCKVNNKALPAPIERTISKAKGQTREPQVYTLAPHREELAKDTVSVTCLVKGFFPADINVEWQRNGQPESEGTYANTPPQLDNDGTYFLYSKLSVGKNTWQQGEVFTCVVMHEALHNHSTQKSITQSSGK

SEQ ID NO: 458 - DNA, 1521 bp, Artificial sequence; identical to SEQ ID NO: 239
  2H7 scFv WTH WTCH2CH3

SEQ ID NO: 459 - protein, 502 aa, Artificial sequence
  2H7 scfV WTH WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFRIPPTFGAGTKLELKDGGGSGGGGSGGGGSSQAYLQQSGAELVRPGASVKMSCKASGYTFTSYNMHWVKQTPRQGLEWIGAIYPGNGDTSYNQKTKGKATLTVDKSSSTAYMQLSSLTSEDSAVYFCARVVYYSNSYWYFDVWGTGTTVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHINHYTQKSLSLSPGK

SEQ ID NO: 460 - DNA, 162 bp, Artificial sequence; identical to SEQ ID NO: 241
  CD80 Transmembrane domain and cytoplasmic tail

SEQ ID NO: 461 - protein, 51 aa, Artificial sequence; identical to SEQ ID NO: 242
  CD80 Transmembrane domain and cytoplasmic tail

SEQ ID NO: 462 - DNA, 399 bp, Artificial sequence; identical to SEQ ID NO: 243
  40.2.220 VL

SEQ ID NO: 463 - protein, 131 aa, Artificial sequence; identical to SEQ ID NO: 244
  30.2.220.VL

SEQ ID NO: 464 - DNA, 368 bp, Artificial sequence; identical to SEQ ID NO: 245
  40.2.220 VH

SEQ ID NO: 465 - protein, 121 aa, Artificial sequence
  40.2.220 VH
QIQLVQSGPELKKPGCTVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVS

SEQ ID NO: 466 - DNA, 812 bp, Artificial sequence; identical to SEQ ID NO: 247
  40.2.220 scFv

SEQ ID NO: 467 - protein, 264 aa, Artificial sequence
  40.2.220 scFv
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPFGGGTKLEIKRGGGGSGGGGSGGGGSQIQVQSGPELKKPGCTVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVS

SEQ ID NO: 468 - DNA, 405 bp, Artificial sequence; identical to SEQ ID NO: 249
  2e12 VL (with L6 VK leader peptide)

SEQ ID NO: 469 - protein, 135 aa, Artificial sequence; identical to SEQ ID NO: 250
  2e12 VL (with L6 VK leader peptide)

SEQ ID NO: 470 - DNA, 369 bp, Artificial sequence; identical to SEQ ID NO: 251
  2e12 VH

SEQ ID NO: 471 - protein, 121 aa, Artificial sequence
  2e12 VH
QVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNTHYYVMDYWGQGTSVTVSS

SEQ ID NO: 472 - DNA, 825 bp, Artificial sequence; identical to SEQ ID NO: 253
  2e12 scFv

SEQ ID NO: 473 - protein, 274 aa, Artificial sequence
  2e12 scFv
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYFLSALKSRLSITKDFLSKSQVFLKMFLSLQTDDTARYYCARDGYSNFHYYVMDYWGQGTSVTVSS

SEQ ID NO: 474 - DNA, 393 bp, Artificial sequence; identical to SEQ ID NO: 255
  10A8 VL (with L6 VK leader peptide)

SEQ ID NO: 475 - protein, 131 aa, Artificial sequence; identical to SEQ ID NO: 256
  10A8 VL

SEQ ID NO: 476 - DNA, 362 bp, Artificial sequence; identical to SEQ ID NO: 257
  10A8 VH

SEQ ID NO: 477 - protein, 119 aa, Artificial sequence; identical to SEQ ID NO: 258
  10A8 VH

SEQ ID NO: 478 - DNA, 806 bp, Artificial sequence; identical to SEQ ID NO: 259
  10A8 scFv

SEQ ID NO: 479 - protein, 264 aa, Artificial sequence
  10A8 scFv
MDFQVQIFSFLLISASVIMSRGVDIQMTQSPSSLSASLGGKVTITCKASQDIKKYIGWYQHKPGKGPRLLIYYTSFLQPGIPSRFSGSGSGRDYSLSIMLEPEDIATYYCQQYDNLPLTFGSGTKLEIKRGGGGSGGGGSGGGGSDVQLQESGPGLVKPSQSLSLTCSVTGYSITSGFWNWIRQFPGNKLEWMGHISHDGRNNYNPSLINRISITRDTSKNQFFLKLSSVTTEDTATYFCARHYGSSGAMDYWGQGTSVTVSSD

SEQ ID NO: 480 - DNA, 1671 bp, Artificial sequence; identical to SEQ ID NO: 265
  40.2.220-hmtlgG1-hCD80

SEQ ID NO: 481 - protein, 556 aa, Artificial sequence
  40.2.220-hmtlgG1-hCD80
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSAFLTAYLQISFLLKDEDTATYFCVRSGNGNYDLAYFAYWGQGTLVTVSDLEPKSSDKTHTSPPSPAPELLGGSSVFLFPPKPKDTLMISRTPEVTCVVVDVSHEDPEVKFHWYVDGVEVHNAKTKPREEQYNSTYRVVSVLTVLHQDWLFLGKEYKCKVSFLKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 482 - DNA, 1683 bp, Artificial sequence; identical to SEQ ID NO: 267
  2e12scFv- hmtlgG1-CD80

SEQ ID NO: 483 - protein, 556 aa, Artificial sequence
  2e12scFv- hmtlgG1-CD80
MDFQVQIFSFFLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMFLSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 484 - DNA, 1665 bp, Artificial sequence; identical to SEQ ID NO: 269
  10A8 scFv-hmtIgG1-CD80

SEQ ID NO: 485 - protein, 553 aa, Artificial sequence
  10A8 scFv-hmtIgG1-CD80
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKRGGGGSGGGGSGGGGSDVQLQESGPGLVKPSQSLSLTCSVTGYSITSGFYWNWIRQFPGNKLEWMGHISHDGRNNYNPSLINRISITRDTSKFLQFFLKLSSVTTEDTATYFCARHYGSSGAMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGFLVFSCSVMHEALHFLHYTQKSLSLSPGKADPSNLLPSWAITLISVNGIFVICCLTYCFAPRCRERRRNERLRRESVRPV

SEQ ID NO: 486 - DNA, 1653 bp, Artificial sequence; identical to SEQ ID NO: 271
  500A2-hmtIgG1-CD80

SEQ ID NO: 487 - protein, 548 aa, Artificial sequence
  500A2-hmtIgG1-CD80
MLYTSQLLGLLLFWISASRSDIVLTQTPATLSLIPGERVTMTCKTSQNIGTILHWYHQKPKEAPRALIKYASQSIPGIPSRFSGSGSETDFILSINNLEPDDIGIYYCQQSRSWPVTFGPGTKLEIKRGGGGSGGGGSGGGGSQVKLQQSGSELGKPGASVKLSCKTSGYIFTDHYISWVKQKPGESLQWIGNVYGGNGGTSYNQKFQGKATLTVDKISSTAYMELSSLTSEDSAIYYCARRPVATGHAMDYWGQGIQVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 488 - DNA, 1521 bp, Artificial sequence; identical to SEQ ID NO: 273
  2H7 scFv MTH(SSS) WTCH2CH3

SEQ ID NO: 489 - protein, 500 aa, Artificial sequence
  2H7 scFv MTH(SSS) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKTHWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - DNA, 39 bp, Artificial sequence; identical to SEQ ID NO: 277
  Primer

SEQ ID NO: 491 - DNA, 51 bp, Artificial sequence; identical to SEQ ID NO: 276
  Primer

SEQ ID NO: 492 - DNA, 64 bp, Artificial sequence; identical to SEQ ID NO: 275
  Primer

SEQ ID NO: 493 - DNA, 52 bp, Artificial sequence; identical to SEQ ID NO: 278
  Primer

SEQ ID NO: 494 - DNA, 56 bp, Artificial sequence; identical to SEQ ID NO: 279
  Primer

SEQ ID NO: 495 - DNA, 30 bp, Artificial sequence; identical to SEQ ID NO: 280
  Primer

SEQ ID NO: 496 - DNA, 54 bp, Artificial sequence; identical to SEQ ID NO: 281
  Primer

SEQ ID NO: 497 - DNA, 50 bp, Artificial sequence; identical to SEQ ID NO: 282
  Primer

SEQ ID NO: 498 - DNA, 51 bp, Artificial sequence; identical to SEQ ID NO: 289
  Primer

SEQ ID NO: 499 - DNA, 1536 bp, Artificial sequence; identical to SEQ ID NO: 283
  2H7 scFv IgAHIGG WTCH2CH3

SEQ ID NO: 500 - protein, 505 aa, Artificial sequence
  2H7 scFv IgAHIGG WTCH2CH3
MDFQVQIFSFLLISASVIIARGQIVLSQSPAILSASPGEKVTMTERASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQPVPSTPPTPSPSTPPTPSPSCAPELLGGPSVFLFPPKPKDTLMISRTPEVTCVVVDVSHEDPEVKTHWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - DNA, 1584 bp, Artificial sequence; identical to SEQ ID NO: 285
  2H7 scFv IgAH IgACH2CH3

SEQ ID NO: 502 - protein, 522 aa, Artificial sequence
  2H7 scFv IgAH IgACH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGFLTTITPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 503 - DNA, 775 bp, Artificial sequence; identical to SEQ ID NO: 287
  IgA hinge-CH2CH3

SEQ ID NO: 504 - protein, 254 aa, Artificial sequence
  IgA hinge-CH2CH3
DQPVPSTPPTPSPSTPPTPSPSCCHPRLSLHRPALEDLLLGSEAILTCTLTGLRDASGVTFTWTPSSGKSAVQGPPDRDLCGEYSVSSVLPGCAEPWNHGKTFTCTAAYPESKTPLTATLSKSGNTFRPEVHLLPPPSEELALNELVTLTELARGFSPKDVLVRWLQGSQELPREKYLTWASRQEPSQGTTTFAVTSILRVAAEDWKKGDTFSEMVGHEALPLAFTQKTIDRLAGKPTHVNVSVVMAEVDGTCY

SEQ ID NO: 505 - DNA, 428 bp, Artificial sequence
  Human J Chain
agatctcaagaagatgaaaggattgttcttgttgacaacaaatgtaagtgtgcccggattacttccaggatcatccgttcttcgaagatcctaatgaggacattgtggagagaaacatccgaattattgttcctctgaacaacagggagaatatctctgatcccacctcaccattgagaaccagatttgtgtaccatttgtctgacctcagctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatctaga

SEQ ID NO: 506 - protein, 139 aa, Artificial sequence
  Human J Chain
RSQEDERIVLVDNKCKCARITSRIIRSSEDPNEDIVERNIRIIVPLNNRENISDPTSPLRTRFVYHLSDLSCKKCDPTEVELDNQIVTATQSNICDEDSATCTCYTYDRNKCYTAVVPLVYGGCTKMVETALTPDACYP

SEQ ID NO: 507 - DNA, 36 bp, Artificial sequence; identical to SEQ ID NO: 292
  Primer

SEQ ID NO: 508 - DNA, 35 bp, Artificial sequence
  Primer
gttgtttctagattagtcaggatagcaggcattgg

SEQ ID NO: 509 - DNA, 4 bp, Artificial sequence
  Synthetic peptide
gtcy

SEQ ID NO: 510 - DNA, 763 bp, Artificial sequence
  IgAH IgAT4
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcccacagaagaccatcgaccgcttggcgggtaaacccacccatgtcaatgtgtctgttgtcatggcggaggtggactgataatctaga

SEQ ID NO: 511 - protein, 248 aa, Artificial sequence
  IgAH IgAT4
DVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTELARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 512 - DNA, 45 bp, Artificial sequence; identical to SEQ ID NO: 297
  Primer

SEQ ID NO: 513 - DNA, 44 bp, Artificial sequence
  Primer
gttgtttctagattatcatttacccgccaagcggtcgatggttt

SEQ ID NO: 514 - DNA, 1571 bp, Artificial sequence
  2H7scFvIgAHIgAT4
aagcttgccgccatggattttcaagtgcagattttcagcttcctgctaatcagtgcttcagtcataattgccagaggacaaattgttcttcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 515 - protein, 516 aa, Artificial sequence
  2H7scFvIgAHIgAT4
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYEQQWSFNPPTFGAGTKLELKDGGGSGGGGSGGGGSSQAYLQQSGAELVRPGASVKMSEKASGYTFTSYNMHWVKQTPRQGLEWIGAIYPGNGDTSYNQKFKGKATLTVDKSSSTAYMQLSSLTSEDSAVYFEARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 516 - protein, 28 aa, Artificial sequence
  Synthetic peptide
PTHVNVSVVMAEVDPTHVNVSVVMAEVD

SEQ ID NO: 517 - DNA, 709 bp, Artificial sequence; identical to SEQ ID NO: 302
  IgAH IgAT18

SEQ ID NO: 518 - protein, 235 aa, Artificial sequence
  IgAH IgAT18
DQPVPSTPPTPSPSTPPTPSPSCCHPRLSLHRPALEDLLLGSEAILTCTHGLRDASGVTFTWTPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGK

SEQ ID NO: 519 - DNA, 1518 bp, Artificial sequence; identical to SEQ ID NO: 304
  2H7 scFv IgAH IgAT18

SEQ ID NO: 520 - protein, 502 aa, Artificial sequence
  2H7 scFv IgAH IgAT18
MDFQVQIFSFLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCRNVGHEALPLAFTQKTIDRLAGK

SEQ ID NO: 521 - DNA, 924 bp, Artificial sequence; identical to SEQ ID NO: 306
  CTLA-4 IgGWTH WTCH2CH3

SEQ ID NO: 522 - protein, 375 aa, Artificial sequence
  CTLA-4 IgGWTH WTCH2CH3
MGVLTQRTLLSLVALLFPSMASMAMHVAQAVVLASSRGTASFVCEYASPGKATEVRVTVLRQADSQVTEVCAATYMMGNEHFLDDSICTGTSSGNQVNHIQGLRAMDTGLYICKVELMYPPPYYLGIGNGTQIYVIDPEPCPDSDQPKSCDKTHTCPPCPAPELLGGPSVFLFPPKPKDTLMISRTPEVTCVVVDVSHEDPEVKFNWYVDGVEVHNAKTKPREEQYNSTYRVVSVHVLHQDWLNGKEYKCKVSNKALPAPIEKTISKAKGQPREPQVYTLPPSRDEHKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 523 - DNA, 453 bp, Artificial sequence; identical to SEQ ID NO: 308
  OncoM leader peptide + CTLA4 EC

SEQ ID NO: 524 - protein, 151 aa, Artificial sequence
  OncoM leader peptide + CTLA4 EC
MGVLLTQRTLLSLVLALLFPSMASMAMHVAQPAVVLASSRGTASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQ

SEQ ID NO: 525 - DNA, 75 bp, Artificial sequence; identical to SEQ ID NO: 311
  OncoM leader peptide

SEQ ID NO: 526 - protein, 22 aa, Artificial sequence
  OncoM leader peptide
MGVLLTQRTLLSLVLALLFPSM

SEQ ID NO: 527 - DNA, 372 bp, Artificial sequence; identical to SEQ ID NO: 313
  Human CTLA4 EC

SEQ ID NO: 528 - protein, 126 aa, Artificial sequence
  Human CTLA4 EC
AMHVAQPAVVLASSRGTASFVCEYASPGKATEVRVTVLRCLADSQVTEVCAATYMTGFLELTFLDDSICTGTSSGNQVNLTIQGLRAMDTGLYICKVELMYPPPYYLGIGNGTQIYVIDPEPCPDS

SEQ ID NO: 529 - DNA, 1149 bp, Artificial sequence; identical to SEQ ID NO: 315
  CTLA4 IgGMTH(SSS) MTCH2CH3

SEQ ID NO: 530 - protein, 383 aa, Artificial sequence
  CTLA4 IgGMTH(SSS) MTCH2CH3
MGVLLTQRTLLSLVLALLFPSMASMAMHVAQPAVVLASSRGTASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPKSSDKTHTSPPSPAPELLGGSSVFLFPPKPKDTLMISRTPEVTCVVVDVSHEDPEVKFFIWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 531 - DNA, 1218 bp, Artificial sequence
  CTLA-4 IgAH IgACH2CH3
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggactcgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccggtcggaggagctggccctgaacgagctggtgacgctgacgtgcctggcacgtggcttcagccccaaggatgtgctggttgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 532 - protein, 402 aa, Artificial sequence
  CTLA-4 IgAH IgACH2CH3
MGVLLTQRTLLSLVLALLFPSMASMAMHVAQPAVVLASSRGTASFVCEYASPGKATEVRVTVLRQADSQVTEVCAATYMMGNELTFLDDSICTGTSSGNQVNHIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFTWIPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFIQKTIDRLAGKPTHVNVSVVMAEVDGTCY

SEQ ID NO: 533 - DNA, 1209 bp, Artificial sequence; identical to SEQ ID NO: 319
  CTLA-4 IgAH IgA-T4

SEQ ID NO: 534 - protein, 400 aa, Artificial sequence
  CTLA-4 IgAH IgA-T4
MGVLLTQRTLLSLVLALLFPSMASMANTHVAQPAVVLASSRGTASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFIWTPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 535 - DNA, 327 bp, Artificial sequence
  IgG1 CH2 P238S
cctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtctcaccgtcctgcaccaggactggctgaatggcaaggagtacaagtgcaaggtctccaacaaagccctcccagcccccatcgagaaaaccatctccaaagccaaag

SEQ ID NO: 536 - protein, 109 aa, Artificial sequence; identical to SEQ ID NO: 322
  IgG1 CH2 P238S

SEQ ID NO: 537 - protein, 10 aa, Artificial sequence
  Synthetic peptide
PAPELLGGPS

SEQ ID NO: 538 - protein, 10 aa, Artificial sequence
  Synthetic peptide
PAPELLGGSS

SEQ ID NO: 539 - DNA, 35 bp, Artificial sequence; identical to SEQ ID NO: 325
  Primer

SEQ ID NO: 540 - DNA, 49 bp, Artificial sequence; identical to SEQ ID NO: 326
  Primer

SEQ ID NO: 541 - DNA, 51 bp, Artificial sequence; identical to SEQ ID NO: 327
  Primer

SEQ ID NO: 542 - DNA, 996 bp, Artificial sequence; identical to SEQ ID NO: 328
  Hu IgE Fc(CH2-CH3-CH4)

SEQ ID NO: 543 - protein, 334 aa, Artificial sequence
  Hu IgE Fc(CH2-CH3-CH4)
DHVESRDFTPPTVKILQSSEDGGGHFPPTIQLLELVSGYTPGTINITWLEDGQVMDVDLSTASTTQEGELASTQSELTLSQKHWLSDRTYTEQVTYQGHTFEDSTKKEADSNPRGVSAYLSRPSPFDLFIRKSPTITELVVDLAPSKGTVFLLTWSRASGKPVNHSTRKEEKQRNGTLTVTSTLPVGTRDWIEGCTYQERVTHPHLPRALMRSTTKTSGPRAAPEVYAFATPEWPGSRDKRTLAELIQNFRNPEDISVQWLHNEVQLPDARHSTTQPRKTKGSGFFVFSRLEVTRAEWEQKDEFIERAVHCAASPSQTVQRAVSVFLPGKADPS

SEQ ID NO: 544 - DNA, 63 bp, Artificial sequence; identical to SEQ ID NO: 330
  Primer

SEQ ID NO: 545 - DNA, 52 bp, Artificial sequence; identical to SEQ ID NO: 278
  Primer

SEQ ID NO: 546 - DNA, 89 bp, Artificial sequence
  Primer
gttgttgatcaggagcccaaatcttctgacaaaactcacacatctccaccgtccccagcacctgaatcctgggtggaccgtcagtctcc

SEQ ID NO: 547 - DNA, 339 bp, Artificial sequence; identical to SEQ ID NO: 335
  1D8 VH

SEQ ID NO: 548 - protein, 113 aa, Artificial sequence
  1D8 VH
QVQLKCAGPGLVQPTQTLSLTCTVSGFSLTSDGVHWIRQPPGKGLEWMGTTYYDGGTDYNSAIKSRLSISRDTSKSQVFLKINSLQTDDTAMYYCARIHFDYWGQGVMVTVSS

SEQ ID NO: 549 - DNA, 321 bp, Artificial sequence; identical to SEQ ID NO: 336
  1D8 VL

SEQ ID NO: 550 - protein, 107 aa, Artificial sequence; identical to SEQ ID NO: 342
  1D8 VL

SEQ ID NO: 551 - DNA, 785 bp, Artificial sequence; identical to SEQ ID NO: 337
  1D8 scFv

SEQ ID NO: 552 - protein, 258 aa, Artificial sequence
  1D8 scFv
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKCAGPGLVQPTQTLSLTCTVSGFSLTSDGVHWIRQPPGKGLEWMGTTYYDGGTDYNSAIKSRLSISRDTSKSQVFLKINSLQTDDTAMYYCARIHFDYWGQGVMVTVSS

SEQ ID NO: 553 - DNA, 1491 bp, Artificial sequence; identical to SEQ ID NO: 338
  1D8 scFv IgGWTH WTCH2CH3

SEQ ID NO: 554 - protein, 492 aa, Artificial sequence
  1D8 scFv IgGWTH WTCH2CH3
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKCAGPGLVQPTQTLSLTCTVSGFSLTSDGVHWIRQPPGKGLEWMGTTYYDGGTDYNSAIKSRLSISRDTSKSQVFLKINSLQTDDTAMYYCARIHFDYWGQGVMVTVSSDQEPKSCDKTHTCPPCPAPELLGGPSVFLFPPKPKDTLMISRTPEVTCVVVDVSHEDPEVKTHWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 555 - DNA, 1645 bp, Artificial sequence
  1D8 scFv IgGMTH MTCH2CH3-CD80
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacaagcccaccgagcccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 556 - protein, 548 aa, Artificial sequence
  1D8 scFv IgG MTH MTCH2CH3-CD80
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKCAGPGLVQPTQTLSLTCTVSGFSLTSDGVHWIRQPPGKGLEWMGTTYYDGGTDYFLSAIKSRLSISRDTSKSQVFLKIFLSLQTDDTAMYYCARIHFDYWGQGVMVTVSSDLEPKSSDKTHTSPPSPAPELLGGSSVFLFBPKPKDTLMISRTPEVTCVVVDVSHEDPEVKFHWYVDGVEVHNAKTKPREEQYNSTYRVVSVLTVLHQDWLNGKEYKCKVSNKALPAPIEKTISKAKGQPREPQVYTLPPSRDELTKFLQVSLTCLVKGFYPSDIAVEWESNGQPENNYKTTPPVLDSDGSFFLYSKLTVDKSRWQQGFLVFSCSVMHEALHFLHYTQKSLSLSPGKADPSNLLPSWAITLISVNGIFVICCLTYCFAPRCRERRRNERLRRESVRPV

SEQ ID NO: 557 - DNA, 1644 bp, Artificial sequence
  1D8 scFv IgGWTH WTCH2CH3-CD80
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggactgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 558 - protein, 544 aa, Artificial sequence
  1D8 scFv IgGWTH WTCH2CH3-CD80
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKLGGGGSGGGGSGGGGSQVQLKCAGPGLVQPTQTLSLTCTVSGFSLTSDGVHWIRQPPGKGLEWMGIIYYDGGTDYFLSAIKSRLSISRDTSKSQVFLKINSLQTDDTAMYYCARIHFDYWGQGVMVTVSSDLEPKSCDKTHTCPPCPAPELLGGPSVFLFPPKPKDTLMISRTPEVTCVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGFLVFSCSVMHEALHNHYTQKSLSLSPGKADPSNLLPSWAITLISVNGIFVICCLTYCFAPRCRERRRNERLRRESVRPV

SEQ ID NO: 559 - DNA, 1527 bp, Artificial sequence; identical to SEQ ID NO: 347
  Anti human CD3 scFv WTH WTCH2CH3

SEQ ID NO: 560 - protein, 510 aa, Artificial sequence
  Anti human CD3 scFv WTH WTCH2CH3
MDFQVQIFSFLLISASVIMSRGVDIQMTQTTSSLSASLGDRVTISCRASQDIRNLYLNWYQQKPDGTVKLLIYYTSRLHSGVPSRFSGSGSGTDYSLTIANLQPEDIATYFCQQGNTLPWTFGGGTKLVTKRELGGGGSGGGGSGGGGSIDEVQLQQSGPELVKPGASMSCKASGYSFTGYIVNWLKQSHGKNLEWIGLIFLPYKGLTTYFLQKFLGKATLTVDKSSSTAYMELLSLTSEDSAVYYCARSGYYGDSDWYFDVWGAGTTVTVSSDQEPKSCDKTHTCPPCPAPELLGGPSVFLFPPKPKDTHMSRTPEVTCVVVDVSHEDPEVKMWYVDGVEVHNAKTKPREEQYNSTYRVVSVLTVLHQDWLFLGKEYKCKVSFLKALPAPIEKTISKAKGQPREPQVYTLPPSRDELTKNQVSLTCLVKGFYPSDIAVEWESFLGQPEFLFLYKTTPPVLDSDGSFFLYSKLTVDKSLWQQGNVFSCSVMHEALHNHYTQKSLSLSPGK

SEQ ID NO: 561 - DNA, 2322 bp, Artificial sequence
  2H7-40.2.220 scFv MTH(SSS) MTCH2WTCH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaatccaactctgaagaagcaaagaaagaggaggccaaaaaggaggaagccaagaaatctaacagcgtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgagatccgggaatggtaactatgacctggctactttgcttactggggccaagggacactggtcactgtctctgatcaggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 562 - protein, 778 aa, Artificial sequence
  2H7-40.2.220 scFv MTH(SSS) MTCH2WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGACLVRPGASVKMSCKASGYTFTSYNMHWVKQTPRQGLEWIGAIYPGFLGDTSYFLQKFKGKATLTVDKSSSTAYMQLSSLTSEDSAVYFEARVVYYSNSYWYFDVWGTGTTVTVSSDQSNSEEAKKEEAKKEEAKKSFLSVDIVLTQSPATLSVTPGDLWSLSCRASQSISDYLHWYQQKSHESPRLLIKYASHSISGIPSRFSGSGSGSDFTLSIFLSVEPEDVGIYYEQHGHSFPWTFGGGTKLEIKRGGGGSGGGGSGGGGSQIQLVQSGPELKKPGCTVTISCKASGYAFTTTGMQWVQEMPGKGLKWIGWIFLTPLWSAKICRRLQGRFAFSLETSANTAYIQISNLKDEDTATYFCVRSGNGNYDLAYFAYWGQGTLVTVSDQEPKSSDKTHTSPPSPAPELLGGSSVFLFPPKPKDTLMISRTPEVTCVVVDVSHEDPEVKTHWYVDGVEVHFLAKTKPREEQYFLSTYRVVSVLTVLHQDWLNGKEYKEKVSNKALPAPIEKTISKAKGQPREPQVYTLPPSRDELTKNQVSLTCLVKGFYPSDIAVEWESFLGQPEFLFLYKTTPPVLDSDGSFFLYSKLTVDKSRWQQGNVFSCSVMHEALHNHYTQKSLSLSPGK

SEQ ID NO: 563 - DNA, 423 bp, Artificial sequence; identical to SEQ ID NO: 353
  5B9 VH with leader peptide

SEQ ID NO: 564 - DNA, 366 bp, Artificial sequence; identical to SEQ ID NO: 354
  5B9 VH with leader peptide

SEQ ID NO: 565 - protein, 140 aa, Artificial sequence
  5B9 VH with leader peptide
MAVLGLLFCLVTFPSCVLSQVQLKQSGPGLVQSSQSLSITCTVSGFSLTTYAVHWVRQSPGKGLEWLGVIWSGGITDYNAAFSRLSITKDDSKSQVFFKMNSLQPNDTAIYYCARNGGDNYPYYYAMDYWGQGTSVTVSS

SEQ ID NO: 566 - protein, 122 aa, Artificial sequence
  5B9 VH lacking leader peptide
QVQLKQSGPGLVQSSQSLSITCTVSGFSLTTYAVHWVRQSPGKGLEWLGVIWSGGITDYNAAFISRLSLTKDDSKSQVFFKMNSLQPNDTAIYYCARNGGDNYPYYYAMDYWGQGTSVTVSS

SEQ ID NO: 567 - DNA, 397 bp, Artificial sequence
  5B9 VL
atgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgctcaaaatctagaacttccgctcacgttcggtgctgggaccaagctggagctgaaacgg

SEQ ID NO: 568 - protein, 133 aa, Artificial sequence; identical to SEQ ID NO: 361
  5B9 VL

SEQ ID NO: 569 - DNA, 825 bp, Artificial sequence; identical to SEQ ID NO: 356
  5B9 scFV

SEQ ID NO: 570 - protein, 270 aa, Artificial sequence
  5B9 scFV
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFSRLSITKDDSKSQVFFKMNSLQPNDTAIYYCARNGGDNYPYYYAMDYWGQGTSVTVSS

SEQ ID NO: 571 - DNA, 1696 bp, Artificial sequence; identical to SEQ ID NO: 358
  5B9 scFV-hmtIgG1-hCD80

SEQ ID NO: 572 - protein, 557 aa, Artificial sequence
  Synthetic peptide
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITIKDDSKSQVFFKMNSLQPNDTALYYCARNGGDNYPYYYAMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 573 - DNA, 1683 bp, Artificial sequence
  2e12 scFV WTHCH2CH3-CD80
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 574 - protein, 558 aa, Artificial sequence
  2e12 scFV WTHCH2CH3-CD80
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNTHYYVMDYWGQGTSVTVSSDLEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSFLKALPAPIEKTISKAKGQPREPQVYTLPPSRDELTKNQVSLTCLVKGFYPSDIAVEWESNGQPENNYKTTPPVLDSDGSFFLYSKLTVDKSRWQQGFLVFSCSVMHEALHNHYTQKSLSLSPGKADPSNLLPSWAITLISVNGIFVICCLTYCFAPRCRERRRNERLRRESVRPV

SEQ ID NO: 575 - DNA, 1800 bp, Artificial sequence; identical to SEQ ID NO: 333
  2H7 IgE Fc CH2CH3CH4

SEQ ID NO: 576 - protein, 592 aa, Artificial sequence
  2H7 IgE Fc CH2CH3CH4
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKTKGKATLTVDKSSSTAYMQLSSLTSEDSAVYFCARVVYYSNSYWYFDVWGTGTTVTVSDHVCSRDFIPPTVKILQSSCDGGGHFPPTIQFLCLVSGYTPGTINIWLEDGEQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGCTYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFLCRAVHCAASPSQTVQRAVSVNPGK

SEQ ID NO: 577 - DNA, 1521 bp, Artificial sequence; identical to SEQ ID NO: 351
  2H7 scFv MH(SSS) MCH2WTCH3

SEQ ID NO: 578 - protein, 508 aa, Artificial sequence
  2H7 scFv MH(SSS) MCH2WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGACLVRPGASVKMSCKASGYTFISYNMHWVKQTPRQGLEWIGAIYPGNGDTSYNQKTKGKATLTVDKSSSTAYMQLSSLTSEDSAVYFCARVVYYSNSYWYFDVWGRGTTVTVSSDQEPKSSDKTHTSPPSPAPELLGGSSVFLFPPKPKDTLRNISRTPEVTCVVVDVSHEDPEVKFRIWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFLGQPEFLFLYKTTPPVLDSDGSFFLYSKLTVDKSRWQQGFLVFSCSVFLTHEALHNHYTQKSLSLSPGK

SEQ ID NO: 579 - DNA, 1536 bp, Artificial sequence; identical to SEQ ID NO: 357
  5B9 scFv MTH WTCH2CH3

SEQ ID NO: 580 - protein, 505 aa, Artificial sequence
  5B9 scFv MTH WTCH2CH3
MRFSAQLLGLLVLWIPGSTADIVMTQAAFSNPVTLGTSASISCRSSKSLLHSNGITYLYWYLQKPGQSPQLLIYQMSNLASGVPDRESSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - DNA, 1520 bp, Artificial sequence
  2H7 ScFV MTH(CSS) WTCH2CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttgatgtctggggcacagggaccacggtcaccgtctcttctgatcaggagcccaaatcttgtgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 582 - protein, 501 aa, Artificial sequence
  2H7 ScFV MTH(CSS) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGACLVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLFLGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - DNA, 1521 bp, Artificial sequence
  2H7 ScFv MTH(SCS) WTCH2CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatgcccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 584 - protein, 502 aa, Artificial sequence
  2H7 ScFv MTH(SCS) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGACLVRPGASVKMSCKASGYTFTSYNMHWVKQTPRQGLEWIGAIYPGNGDTSYNQKTKGKATLTVDKSSSTAYMQLSSLTSEDSAVYFCARVVYYSNSYWYFDVWGTGTTVTVSSDQEPKSSDKTHTCPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSFLKALPAPIEKTISKAKGQPREPQVYTLPPSRDELTKNQVSLTCLVKGFYPSDIAVEWESNGQPENNYKTTPPVLDSDGSFFLYSKLTVDKSRWQQGFLVFSCSVMHEALHNHYTQKSLSLSPGK

SEQ ID NO: 585 - DNA, 1521 bp, Artificial sequence
  2H7 scFv MTH(SSC) WTCH2CH3
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 586 - protein, 500 aa, Artificial sequence
  2H7 scFv MTH(SSC) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - DNA, 44 bp, Artificial sequence; identical to SEQ ID NO: 390
  Primer

SEQ ID NO: 588 - DNA, 54 bp, Artificial sequence; identical to SEQ ID NO: 391
  Primer

SEQ ID NO: 589 - DNA, 63 bp, Artificial sequence; identical to SEQ ID NO: 392
  Primer

SEQ ID NO: 590 - DNA, 324 bp, Artificial sequence; identical to SEQ ID NO: 370
  HuIgG1 MTCH3Y405

SEQ ID NO: 591 - protein, 107 aa, Artificial sequence; identical to SEQ ID NO: 375
  HuIgG1 MTCH3Y405

SEQ ID NO: 592 - DNA, 324 bp, Artificial sequence; identical to SEQ ID NO: 371
  HuIgG1 MTCH3A405

SEQ ID NO: 593 - protein, 107 aa, Artificial sequence; identical to SEQ ID NO: 376
  HuIgG1 MTCH3A405

SEQ ID NO: 594 - DNA, 324 bp, Artificial sequence; identical to SEQ ID NO: 372
  HuIgG1 MTCH3A407

SEQ ID NO: 595 - protein, 107 aa, Artificial sequence; identical to SEQ ID NO: 377
  HuIgG1 MTCH3A407

SEQ ID NO: 596 - DNA, 324 bp, Artificial sequence; identical to SEQ ID NO: 373
  HuIgG1 MTCH3Y405A407

SEQ ID NO: 597 - protein, 107 aa, Artificial sequence; identical to SEQ ID NO: 378
  HuIgG1 MTCH3Y405A407

SEQ ID NO: 598 - DNA, 324 bp, Artificial sequence; identical to SEQ ID NO: 374
  HuIgG1 MTCH3A405A407

SEQ ID NO: 599 - protein, 107 aa, Artificial sequence; identical to SEQ ID NO: 379
  HuIgG1 MTCH3A405A407

SEQ ID NO: 600 - DNA, 1521 bp, Artificial sequence; identical to SEQ ID NO: 381
  2H7 scFv MTH(SSS) WTCH2MTCH3Y405

SEQ ID NO: 601 - protein, 506 aa, Artificial sequence
  2H7 scFv MTH(SSS) WTCH2MTCH3Y405
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFHPPTFGAGTKLELKDGGGSGGGGSGGGGSSQAYLQQSGAELVRPGASVKMSCKASGYTFTSYNMHWVKQTPRQGLEWIGAIYPGFLGDTSYFLQKFKGKATLTVDKSSSTAYLMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLFLGKEYKCKVSFLKALPAPIEKTISKAKGQPREPQVYTLPPSREEMTKNQVSLTCLVKGFYPSDIAVEWESNGQPEFLFLYKTTPPVDSDGSFYLYSKLTVDKSRWQQGNVFSCSVMHEALHNHYTQKSLSLSPGK

SEQ ID NO: 602 - DNA, 1515 bp, Artificial sequence; identical to SEQ ID NO: 380
  2H7 scFv MTH(SSS) WTCH2MTCH3A405

SEQ ID NO: 603 - protein, 502 aa, Artificial sequence
  2H7 scFv MTH(SSS) WTCH2MTCH3A405
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKTKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFRIWYVDGVEVHNAKTKPREEQYNSTYRVVSVLTVLHQDWLNGKEYKCKVSFLKALPAPIEKTISKAKGQPREPQVYTLPPSREEMTKNQVSLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 604 - DNA, 1515 bp, Artificial sequence; identical to SEQ ID NO: 382
  2H7 scFv MTH(SSS) WTCH2MTCH3A407

SEQ ID NO: 605 - protein, 504 aa, Artificial sequence
  2H7 scFv MTH(SSS) WTCH2MTCH3A407
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSLHPPTFGAGTKLELKDGGGSGGGGSGGGGSSQAYLQQSGACLVRPGASVKMSCKASGYTFTSYNMHWVKQTPRQGLEWIGAIYPGFLGDTSYFLQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSFLKALPAPIEKTISKAKGQPREPQVYTLPPSREEMTKNQVSLTCLVKGFYPSDIAVEWESNGQPENNYKTTPPVLDSDGSFFLASKLTVDKSRWQQGFLVFSCSVMHEALHNHYTQKSLSLSPGK

SEQ ID NO: 606 - DNA, 1515 bp, Artificial sequence; identical to SEQ ID NO: 383
  2H7 scFv MTH(SSS) WTCH2MTCH3Y405A407

SEQ ID NO: 607 - protein, 501 aa, Artificial sequence
  2H7 scFv MTH(SSS) WTCH2MTCH3Y405A407
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFRIPPTFGAGTKLELKDGGGSGGGGSGGGGSSQAYLQQSGACLVRPGASVKMSCKASGYTFISYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKTHWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFYLASKLTVDKSRWQQGNVFSCSVMHEALHNHYTQKSLSLSPGK

SEQ ID NO: 608 - DNA, 1515 bp, Artificial sequence; identical to SEQ ID NO: 384
  2H7 scFv MTH(SSS) WTCH2MTCH3A405A407

SEQ ID NO: 609 - protein, 500 aa, Artificial sequence
  2H7 scFv MTH(SSS) WTCH2MTCH3A405A407
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGACLVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNLALPAPIEKTISKAKGQPREPQVYTLPPSREEMTKNQVSLTCLVKGFYPSDIAVEWESNGQPENNYKTTPPVLDSDGSFALASKLTVDKSRWQQGNVFSCSVMHEALHNHYTQKSLSLSPGK

SEQ ID NO: 610 - DNA, 1521 bp, Artificial sequence; identical to SEQ ID NO: 393
  2H7 scFv MTH(SCC) WTCH2CH3

SEQ ID NO: 611 - protein, 500 aa, Artificial sequence
  2H7 scFv MTH(SCC) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGACLVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 612 - DNA, 1521 bp, Artificial sequence; identical to SEQ ID NO: 394
  2H7 scFv MTH(CSC) WTCH2CH3

SEQ ID NO: 613 - protein, 498 aa, Artificial sequence
  2H7 scFv MTH(CSC) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGACLVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGENNYKTTPPVLDSDGSFFLYSKLTVDKSRWQQGNVFSCSVMHEALHNHYTQKSLSLSPGK

SEQ ID NO: 614 - DNA, 1521 bp, Artificial sequence; identical to SEQ ID NO: 395
  2H7 scFv MTH(CCS) WTCH2CH3

SEQ ID NO: 615 - protein, 500 aa, Artificial sequence
  2H7 scFv MTH(CCS) WTCH2CH3
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKTKGKATLTVDKSSSTAYMQLSSLTSEDSAVYFCARVVYYSNSYWYFDVWGTGTTVTVSSDQEPKSCDKTHTCPPSPAPELLGGPSVFLFPPKPKDFLMISRTPEVTCVVVDVSHEDPEVKTHWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 616 - DNA, 766 bp, Artificial sequence
  2H7 scFv MTH(CCS) WTCH2CH3
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaac

SEQ ID NO: 617 - protein, 254 aa, Artificial sequence
  HuIgAHIgA-T4
DPVPSTPPTPSPSTPPTPSPSCCHPRLSLHRPALEDLLLGSEAILTCTLTGLRDASGVTFTWTPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAACDWKKGDTFSCMVGHEALPLAFTQKTIDRLAGKPTHVNVSVVMAEVDADPSN

SEQ ID NO: 618 - DNA, 766 bp, Artificial sequence; identical to SEQ ID NO: 616
  HuIgAHIgA-T4

SEQ ID NO: 619 - protein, 255 aa, Artificial sequence
  HuIgAHIgA-T4
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCACPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAACDWKKGDTFSCMVGHEALPLAFTQKTIDRLAGKPTHVNVSVVMAEVDADPSN

SEQ ID NO: 620 - DNA, 1697 bp, Artificial sequence
  1D8-IgAH IgAT4-CD80
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatac

SEQ ID NO: 621 - protein, 560 aa, Artificial sequence
  1D8-IgAH IgAT4-CD80
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKCAGPGLVQPTQTLSLTCTVSGFSLTSDGVHWIRQPPGKGLEWMGTTYYDGGTDYNSAIKSRLSISRDTSKSQVFLKINSLQTDDTAMYYCARIHFDYWGQGVMVTVSSDQPVPSTPPTPSPSTPPTPSPSCCHPRLSLHRPALEDLLLGSEAILTCTLTGLRDASGVTFIWTPSSGKSAVQGPPDRDLCGCYSVSSVLPGCACPWNHGKTFICTAAYPESKTPLTATLSKSGNTFRPEVHLLPPPSEELALNELVTLTCLARGFSPKDVLVRWLQGSQELPREKYLTWASRQEPSQGTTTFAVTSILRVAACDWKKGDTFSCMVGHEALPLAFTQKTIDRLAGKPTHVNVSVVMAEVDADPSNNLLPSWAITLISVNGIFVICCLTYCFAPRCRERRRNERLRRESVRPV

SEQ ID NO: 622 - DNA, 996 bp, Artificial sequence; identical to SEQ ID NO: 328
  IgE Fc CH3--CH3-CH4

SEQ ID NO: 623 - protein, 330 aa, Artificial sequence
  IgE Fc CH3-CH3-CH4
DHVCSRDFTPPTVKILQSSCDGGGHFPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNHWSRASGKPVNHSTRKEEKQRNGTLTVTSTLPVGTRDWIEGCTYQCRVTHPHLPRALMRSTTKTSGPRAAPEVYAFATPEWPGSRDKRTLACLIQNFRNPEDISVQWLHNEVQLPDARHSTTQPRKTKGSGFFVFSRLEVTRAEWEQKDEFICRAVHCAASPSQTVQRAVSVNPGKADPS

SEQ ID NO: 624 - DNA, 1921 bp, Artificial sequence
  1D8 IgE Fc CH3CH3CH4-CD80
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaagctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 625 - protein, 633 aa, Artificial sequence
  1D8 IgE Fc CH3CH3CH4-CD80
MDFQVQIFSFLLISASVIMSRGVDIVHQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKCAGPGLVQPTQTLSLTCTVSGFSLTSDGVHWIRQPPGKGLEWMGTTYYDGGTDYNSAIKSRLSISRDTSKSQVFLKINSLQTDDTAMYYCARIHFDYWGQGVMVTVSSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQMGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHCAASPSQTVQRAVSVNPGKADPSKLPSWAITLISVNGIFVICCLTYCFAPRCRERRRNERLRRESVRPV

SEQ ID NO: 626 - DNA, 1742 bp, Artificial sequence
  5B9 IgAH IgAT4-CD80
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatac

SEQ ID NO: 627 - protein, 573 aa, Artificial sequence
  5B9 IgAH IgAT4-CD80
MRFSAQLLGLLVLWIPGSTADIVMTQAAFSNPVTLGTSASISCRSSKSLLHSNGTTYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGTTDYNAAFISRISITKDDSKSQVFTKMNSLQPNDTAIYYCARNGGDNYPYYYAMDYWGQGTSVTVSSDQPVPSTPPTPSPSTPPTPSPSCCHPRLSLHRPALEDLLLGSEAILTCTLTGLRDASGVTFIWTPSSGKSAVQGPPDRDLCGCYSVSSVLPGCACPWNHGKTFICTAAYPESKTPLTATLSKSGNTFRPEVHLLPPPSEELALNELVTLTCLARGFSPKDVLVRWLQGSQELPREKYLTWASRQEPSQGTTTFAVTSILRVAACDWKKGDTFSCMVGHEALPLAFTQKTIDRLAGKPTHVNVSVVMAEVDADPSNNLLPSWAITLISVNGIFVICCLTYCFAPRCRERRRNERLRRESVRPV

SEQ ID NO: 628 - DNA, 1966 bp, Artificial sequence
  5B9 IgE Fc CH2-CH3-CH4-CD80
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggrggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaagctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 629 - protein, 648 aa, Artificial sequence
  5B9 IgE Fc CH2-CH3-CH4-CD80
MRFSAQLLGLLVLWIPGSTADIVMTQAAFSNPVTLGTSASISCRSSKSLLHSNGTTYLYWYLQKPGQSPQLLIYQMSNLASGVPDRFSSSGSGTDFILRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGTTDYNAAFISRLSITKDDSKSQVFFKMNSLQPNDTAIYYCARNGGDNYPYYYAMDYWGQGTSVTVSSDHVCSRDFIPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGCTYQCRVTHPHLPRALMRSTTKTSGPRAAPEVYAFATPEWPGSRDKRTLACLIQNFRNPEDISVQWLHNEVQLPDARHSTTQPRKTKGSGFFVFSRLEVTRAEWEQKDEFICRAVHEAASPSQTVQRAVSVNPGKADPSKLPSWAITLISVNGIFVICCLTYCFAPRCRERRMERLRRESVRPV

SEQ ID NO: 630 - DNA, 1736 bp, Artificial sequence
  2e12 IgAH IgAT4-CD80
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatac

SEQ ID NO: 631 - protein, 571 aa, Artificial sequence
  2e12 IgAH IgAT4-CD80
MDFQVQIFSFLLISASVIRNSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKNSLQTDDTARYYCARDGYSNFHYYVMDYWGQGTSVTVSSDQPVPSTPPTPSPSTPPTPSPSCCHPRLSHRPALEDLLLGSEAILTCTLTGLRDASGVTFLWTPSSGKSAVQGPPDRDLCGCYSVSSVLPGCACPWNHGKTFTCTAAYPESKTPLTATLSKSGNTFREVHLLPPPSEELALNEIVTLTCLARGFSPKDVLVRWIQGSQELPREKYLTWASRQEPSQGTTTFAVTSILRVAAEDWKKGDTFSCMVGHEALPLAFTQKTIDRLAGKPTHVNVSVVMAEVDADPSNNLLPSWAITLISVNGIFVICCLTYCFAPRCRERRRNERLRRESVRPV

SEQ ID NO: 632 - DNA, 1960 bp, Artificial sequence
  2e12 IgE Fc CH2-CH3-CH4-CD80
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaagctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 633 - protein, 649 aa, Artificial sequence [sequence omitted]

SEQ ID NO: 634 - DNA, 793 bp, Artificial sequence; identical to SEQ ID NO: 399
  500A2 scFv

SEQ ID NO: 635 - protein, 263 aa, Artificial sequence
  500A2 scFv
MLYTSQLLGLLLFWISASRSDIVLTQTPATLSLIPGERVTMTCKTSQNIGTILHWYHQKPKEAPRALIKYASQSIPGIPSRFSGSGSETDFTLSINNLEPDDIGIYYCQQSRSWPVTFGPGTKLEIKRGGGGSGGGGSGGGGSQVKLQQSGSELGKPGASVKLSCKTSGYIFTDHYISWVKQKPGESIQWIGNVYGGNGGTSYNQKFQGKATLTVDKISSTAYMESSLTSEDSAIYYCARRPVATGHAMDYWGQGIQVTVSSD

SEQ ID NO: 636 - DNA, 36 bp, Artificial sequence; identical to SEQ ID NO: 401
  Primer

SEQ ID NO: 637 - DNA, 44 bp, Artificial sequence; identical to SEQ ID NO: 402
  Primer

SEQ ID NO: 638 - DNA, 47 bp, Artificial sequence; identical to SEQ ID NO: 403
  Primer

SEQ ID NO: 639 - DNA, 45 bp, Artificial sequence; identical to SEQ ID NO: 404
  Primer

SEQ ID NO: 640 - DNA, 48 bp, Artificial sequence; identical to SEQ ID NO: 405
  Primer

SEQ ID NO: 641 - DNA, 51 bp, Artificial sequence
  Primer
gttgttatcgatctcgagttatcaggacgcttcggaggtagatgcgtcadd

SEQ ID NO: 642 - DNA, 657 bp, Artificial sequence; identical to SEQ ID NO: 407
  CssCFv

SEQ ID NO: 643 - protein, 210 aa, Artificial sequence
  CssCFv
VDPSNPFLVLLHSVSSSLSSSELTELKFLCLGRVGKRKLERVQSGLDLFSMLLEQNDLEPGHTELLRELLASLRRHDLLRRVDDFCAGAAAGAAPGCCDLCAAFHVICDNVGKDWRRLARQLKVSDTKIDSIEDRYPMLTERVRESLRIWKNTEKENATVAHLVGALRSCQMNLVADLVQEVQQARDLQNRSGAMSPMSWNSDASTSEAS

SEQ ID NO: 644 - DNA, 60 bp, Artificial sequence; identical to SEQ ID NO: 409
  Primer

SEQ ID NO: 645 - DNA, 60 bp, Artificial sequence; identical to SEQ ID NO: 410
  Primer

SEQ ID NO: 646 - DNA, 32 bp, Artificial sequence; identical to SEQ ID NO: 411
  Primer

SEQ ID NO: 647 - DNA, 33 bp, Artificial sequence; identical to SEQ ID NO: 412
  Primer

SEQ ID NO: 648 - DNA, 28 bp, Artificial sequence
  Primer
gttgtggatcctcctgctcccatcctgg

SEQ ID NO: 649 - DNA, 32 bp, Artificial sequence; identical to SEQ ID NO: 414
  Primer

SEQ ID NO: 650 - DNA, 45 bp, Artificial sequence; identical to SEQ ID NO: 415
  Primer

SEQ ID NO: 651 - DNA, 42 bp, Artificial sequence; identical to SEQ ID NO: 416
  Primer

SEQ ID NO: 652 - DNA, 645 bp, Mus musculus; identical to SEQ ID NO: 417
  FADD

SEQ ID NO: 653 - protein, 209 aa, Mus musculus
  FADD
VDPSNMDPFLVLLHSLSGSLSGNDLMELKFLCRERVSKRKLERVQSGLDLFTVLLEQNDLERGHTGLLRELLASLRRHDLLQRLDDFCAGTATAAPPGCADQVAFDIVCDNVGRDWKRLARELKVSEAKMDGIEEKYPRSLSERVRESLKVWKNAEKKNASVAGLVKALRTCRLNLVADLVEEAQCSVSKSENMSPVLRDSTVSSSETP

SEQ ID NO: 654 - DNA, 48 bp, Artificial sequence; identical to SEQ ID NO: 419
  Primer

SEQ ID NO: 655 - DNA, 45 bp, Artificial sequence
  Primer
gttgttatcgatctcgagctagtgataaaagtacagttctttcgt

SEQ ID NO: 656 - DNA, 46 bp, Artificial sequence; identical to SEQ ID NO: 421
  Primer

SEQ ID NO: 657 - DNA, 48 bp, Artificial sequence; identical to SEQ ID NO: 422
  Primer

SEQ ID NO: 658 - DNA, 45 bp, Artificial sequence; identical to SEQ ID NO: 423
  Primer

SEQ ID NO: 659 - DNA, 48 bp, Artificial sequence; identical to SEQ ID NO: 424
  Primer

SEQ ID NO: 660 - DNA, 45 bp, Artificial sequence; identical to SEQ ID NO: 425
  Primer

SEQ ID NO: 661 - DNA, 48 bp, Artificial sequence; identical to SEQ ID NO: 426
  Primer

SEQ ID NO: 662 - DNA, 91 bp, Artificial sequence; identical to SEQ ID NO: 332
  Synthetic nucleotide

SEQ ID NO: 663 - DNA, 1798 bp, Artificial sequence
  2H7-human IgE CH2-CH3-CH4
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 664 - protein, 592 aa, Artificial sequence
  2H7-human IgE CH2-CH3-CH4)
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGACLVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGCTYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHCAASPSQTVQRAVSVNPGK

SEQ ID NO: 665 - DNA, 1521 bp, Artificial sequence; identical to SEQ ID NO: 351
  2H7 scFv MH(SSS) MCH2WTCH3

SEQ ID NO: 666 - protein, 499 aa, Artificial sequence
  2H7 scFv MH(SSS) MCH2WTCH3
MDFQVQIFSFLLISASVIIARGQIVLSQSPAILSASPGEKVTMTCRASSSVSYMHWYQQKPGSSPKPWIYAPSNLASGVPARFSGSGSGTSYSHISRVEAEDAATYYCQQESFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 667 - DNA, 1532 bp, Artificial sequence
  5B9 scFv MTHWTCH2CH3
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcactgagaatcagcagagtggaggctgaggatgcctatttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 668 - protein, 503 aa, Artificial sequence
  5B9 scFv MTHWTCH2CH3
MRFSAQLLGLLVLWIPGSTADIVMTQAAFSNPVTLGTSASISCRSSKSLLHSNGTTYLYWYLQKPGQSPQLLIYQMSNLASGVPDRFSSSGSGTDFTLRISRVEAEDVGVYYCAQNLELPLTFGAGTKLELKGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFAYSKLTVDKSRWQQGNVFSCSVMHEALHNHYTQKSLSLSPGK

What is claimed is:

1. A fusion protein, comprising:
   (a) a binding domain polypeptide that binds CD20, wherein the binding domain comprises amino acids 23-265 of SEQ ID NO:397 except that leucine at position 155 of SEQ ID NO:397 is substituted with a serine,
   (b) a human IgG1 hinge peptide comprising a mutated core sequence as set forth in amino acids 279-282 of SEQ ID NO:397, 398 or 582,
   (c) an immunoglobulin heavy chain CH2 constant region polypeptide as set forth in amino acids 284-393 of SEQ ID NO:397 fused to the hinge peptide,
   (d) an immunoglobulin heavy chain CH3 constant region polypeptide as set forth in amino acids 39-500 of SEQ ID NO:397 fused to the CH2 polypeptide, and
   wherein the fusion protein promotes antibody dependent cell-mediated cytotoxicity, complement fixation, or both.

2. A composition comprising a fusion protein of claim 1 and a pharmaceutically acceptable excipient, diluent, or carrier.

3. A fusion protein, comprising:
   (a) a binding domain polypeptide that binds CD20, wherein the binding domain comprises complementary determining regions of amino acids 46-55, 71-76, and 110-118 of an immunoglobulin light chain variable region as set forth in amino acids 23-128 of SEQ ID NO:397 fused via a linker polypeptide to a sequence comprising complementary determining regions of amino acids 175-179, 194-210, and 243-255 of a full-length immunoglobulin heavy chain variable region as set forth in amino acids 145-265 of SEQ ID NO:397, wherein the linker comprises amino acids 129-144 of SEQ ID NO:397,
   (b) a human IgG1 hinge peptide comprising a mutated core sequence as set forth in amino acids 279-282 of SEQ ID NO:397, (c) an immunoglobulin heavy chain CH2 constant region polypeptide as set forth in amino acids 284-393 of SEQ ID NO:397 fused to the hinge peptide, (d) an immunoglobulin heavy chain CH3 constant region polypeptide as set forth in amino acids 394-500 of SEQ ID NO:397 fused to the CH2 polypeptide, and wherein the fusion protein promotes antibody dependent cell-mediated cytotoxicity, complement fixation, or both.

4. The fusion protein of claim 1 wherein the hinge peptide comprises amino acids 279-282 as set forth in SEQ ID NO:397.

5. The fusion protein of claim 1 wherein the hinge peptide comprises amino acids 279-282 as set forth in SEQ ID NO:398.

6. The fusion protein of claim 1 wherein the hinge peptide comprises amino acids 279-282 as set forth in SEQ ID NO:582.

7. The fusion protein of claim 3 wherein the binding domain polypeptide has a serine at position 11 in the immunoglobulin heavy chain variable region polypeptide.

8. A composition comprising a fusion protein of claim 3 and a pharmaceutically acceptable excipient, diluent, or carrier.

* * * * *

UNITED STATES PATENT AND TRADEMARK OFFICE
CERTIFICATE OF CORRECTION

PATENT NO.           : 7,754,208 B2                         Page 1 of 1
APPLICATION NO.      : 10/207655
DATED                : July 13, 2010
INVENTOR(S)          : Jeffrey A. Ledbetter et al.

It is certified that error appears in the above-identified patent and that said Letters Patent is hereby corrected as shown below:

Column 191
Claim 1, Line 62, "polypeptide as set forth in amino acids 39-500 of SEQ" should read as
--polypeptide as set forth in amino acids 394-500 of SEQ--.

Signed and Sealed this
First Day of March, 2011

David J. Kappos
*Director of the United States Patent and Trademark Office*